United States Patent 9,976,157 (ISOLATED POLYNUCLEOTIDES AND POLYPEPTIDES, AND METHODS OF USING SAME FOR INCREASING PLANT YIELD AND/OR AGRICULTURAL CHARACTERISTICS) - sequence listing, part 4

SEQ ID NO: 5086 - DNA, 1468 bp, Sorghum bicolor
ggcgtggctacctcacgagtccatcagctcgtctgctctgctccgcccgtcggcctctatcgctgctcctccccttcctctcccgcgggctctcccgcacgaatccgaatcagtaagctaatccagtccggcgacctaggtctctcagctcgcccgctggtcagtaatggcgcaggatgatccggttgtttctcctcagtggctgcacgagcacctaggaatgcctgatgtcaaggttttggatgcttcctggtacatgccggtagagaacagggatccatgggaagaatatcaggtggcacacatccctggtgcgctattcttcgacttagatggcatagttgatccgacaactgatttaccacacatgttgccatcagaagaggcttttgcagcagcaatctctgagctggatataaaaaaccaggataaagttattatttatgatggaaagggattcttcagtgcacctcgtgtttggtggatgtttagagtgtttggacacacaaaagtctgggtattagacggaggtttacctctgtggcgagcttctgggttcaatgtggaaaacgtcagctctggtgatgcagttctgaaatcaaatgccgcaaataaggctgtcgaaagggtttataatggtgaacagacaaatacaatcacatttcacactgaatttcagcctaatctattctggtcactggaaaaggttgcccataatgtgactgctaagacttaccaacaaatagatgccagagcaaagggcagatttgatggtgtagcaccagaaccacggaaaggagtaagaagtggacatataccaggaagcatatgtgttccattccctgagatgttcgatggtgcaccaagccttctctctgcagatgagctgcggcaaaagtttcagcaagcaggaatttccctagatcaacccatcgtcgtcacttgcggatctggcgtgactgcctgcatacttgctctggggctctacaggattggaagacatgatgttccagtttatgatggatcttggacagaatgggaggcacaatcagattccgattacccaaaaatcactgctcctgcttgttaagctcaccagctctgaaaagattaattcagtttgagcatcttggaccattcagtttagatcgtcagcaagaggatattatgttgtaacaagctttgcactaaataaatgccaatcttatatggatgagaaatgtgcaatatgtgttatgttgtcctgtcgcaaaaagagatgaaagggaacaagtaaaacaggacatctcaactgatttgattcaatattgtaaacattttatttaccatacagattagtaccatgctcgcggtattgtatctagatgaggcaagttcttgtttattgcatcatactggcaacatgagggttaatgtatgagagtatttcttttgtaaacttgggtctaaaatggaggtggttttcttc

SEQ ID NO: 5087 - DNA, 1371 bp, Sorghum bicolor
agacgatcaaccgtgactgaagcacagacatgagttcaaatttcagctcgtctgctctgctccgcccgtcggcctctatcgctgctcctccccttcctctcccgcgggctctcccgcacgaatccgaatcagtaagctaatccagtccggcgacctaggtctctcagctcgcccgctggtcagtaatggcgcaggatgatccggttgtttctcctcagtggctgcacgagcacctaggaatgcctgatgtcaaggttttggatgcttcctggtacatgccggtagagaacagggatccatgggaagaatatcaggtggcacacatccctggtgcgctattcttcgacttagatggcatagttgatccgacaactgatttaccacacatgttgccatcagaagaggcttttgcagcagcaatctctgagctggatataaaaaaccaggataaagttattatttatgatggaaagggattcttcagtgcacctcgtgtttggtggatgtttagagtgtttggacacacaaaagtctgggtattagacggaggtttacctctgtggcgagcttctgggttcaatgtggaaaacgtcagctctggtgatgcagttctgaaatcaaatgccgcaaataaggctgtcgaaagggtttataatggtgaacagacaaatacaatcacatttcacactgaatttcagcctaatctattctggtcactggaaaaggttgcccataatgtgactgctaagacttaccaacaaatagatgccagagcaaagggcagatttgatggtgtagcaccagaaccacggaaaggagtaagaagtggacatataccaggaagcatatgtgttccattccctgagatgttcgatggtgcaccaagccttctctctgcagatgagctgcggcaaaagtttcagcaagcaggaatttccctagatcaacccatcgtcgtcacttgcggatctggcgtgactgcctgcatacttgctctggggctctacaggattggaagacatgatgttccagtttatgatggatcttggacagaatgggaggcacaatcagattccgattacccaaaaatcactgctcctgcttgttaagctcaccagctctgaaaagattaattcagtttgagcatcttggaccattcagtttagatcgtcagcaagaggatattatgttgtaacaagctttgcactaaataaatgccaatcttatatggatgagaaatgtgcaatatgtgttatgttgtcctgtcgcaaaaagagatgaaagggaacaagtaaaacaggacatctcaactgatttgattcaatattgtaaacattttatttaccatacagattagtaccatgctcgcgg

SEQ ID NO: 5088 - DNA, 1485 bp, Panicum virgatum
ctggctcaatggcggcttgctgccgcttacaagctgaattatttgcgctcttttgattctcctccttggaggttatcccctagaaatctcacctgcgagcttctttttctagctaatccagtccgctcggtctctctgcaagcccgcacgtcggctatggcgcaggatgatccggttgtttctgctcagtggctgcacctgcacctaggagcgcctgacgttaaggttttggatgcttcctggtacatgctggtagagaacagggatccatgggaagaataccaggtggcacatatccctggtgcgttgttcttcaacatagatggcatagtcgatcagaaaactgacttaccacacatgttgccatcagaagaggcttttgcagcagcagtttctgcgctggatataaaaaaccaggataaagttattgtttatgatggaaaaggattcttcagtgcacctcgtgtttggtggatgtttagagtttttgggcacaataaagtttgggtgttagatggaggtttacctcagtggcgagcttcagggtttgatcttggaagtgccaaccctgatgatgcagttcttaaatccaaaactgccaataaggctgttgaaagggtttataatggtgaactgacaaatacaatcgcattcaagactgaatttcagcctcatctatattggacactggaaaaggtcgcgcataatgttgctgctaagaattaccaacaagtagatgccagatcaaagggcagatttgatggtgtagcaccagaaccacgggaaggagtgagaagtggacatataccaggaagcagatgtgttccgttcccagagatgtttgatggtgcaccaaggcttctgtccgctgatgagctgaggaaaaagtttcagcaagcaggaatttctcttgaccaccccattgttgtcagttgcggatctggcgtgactgcctgcatacttgctctggggctctatagaattgggaagcatgatgttccagtttatgatggatcttggacagaatgggaagcacaatcagattctgattacccaaaagctaccgccactgctgcttaaaatccccaactataaagagatgtgaaacagtccatccatcctggagcattcagtttagaatgtcagcaaagatgacatttccatgttacaagctttgcacttaaacaaaggcaaagcttataagggcaagaaatgcccaaagagatgaagagaacatgaagcagggacagaaagtgcaccttgtcaattcttgtgaccctattgtcagcatcgaacttatggttgacatctactagcgtcattgtatttacccatgctcacgatattgcagctaaatgagttaagaatggcaaattcttgtttttggatcaaaatatgaggattaatgtatgagagtttcaactctcacaacattttttattttgcaaagtcgattaaattggatatggaaattgtttttttttg

SEQ ID NO: 5089 - DNA, 1463 bp, Setaria italica
ggccaaaacttatttgtttatactaaattccttgacgtggctgcctcacgggtccaaatcggctcatctgctccgctcatcgtctccctcctcgccgtctcgagccctgcgctgcgccctttctctcttctgccggaatccgaatcgacaaggtcggcaatggcgcaggatgatccggttgtttctgctcagtggctgcaccagcacctaggagcgcctgatgttaaggttttggatgcttcctggtacatgccggtagagaacaggaatccatgggaagaataccaggtggcacatatccctggcgcagttttcttcgacatagatgccatagtcgatcggacaactgatttaccacacatgttgccatcagaagaggcttttgcagcagcagtttccgcgctggatataaaaaaccaggataaagttattgtttatgatggaaaaggattctttagtgcgcctcgtgtttggtggatgtttagagtttttgggcacaataaagtttgggtgctagatggaggtttacctcagtggcgagcttcagggtttgatctgggaagtgccagccctgatgatgcagtactgaaatcaaaagctgccagtaaggctgttgaaagagtttataacagtgaaccgacaaatataatcacctttcagactgaatttcaaccccgcctattatggacactggaaaaggttgcacataatgtcgctgctaagacttaccaacaagtagatgccagatcaaagggcagatttgatggtgtagcgccagaaccacgggaaggagtaagaagtggacacataccaggaagcaaatgtgttccattcccagagatgtttgatggtgcaccaaggcttctctccacagatgagctgaggcaaaaatttcagcaagcaggaatttcccttgaccaccccattgttgtcagttgcggatctggtgtaactgcctgcatacttgctctggggctctatagaattggaaagcacaacgttccagtttatgatggatcttggacagaatgggaagcacaatcagattctcattacccaaaagctaccaccactgcttaaattccccaactctgaaaaggcgaaatacagttcatccatccttcctggagcattcagtttagattgtcagcaaagatggcatttccctgtgacaagctttgcacttaaacaaaggtgaaaagcttataggggcaagaagtgcgtagtacaatgctgtcctgtgattggaagagataatagaacatgtaaagcaggaacagaaagtgcacccttgctaattcttgtgaccctattgtcaacatcaaatttgtggttgacatctactaatgttatcattcaaggaataagctttaagacaatgctaacaatccaaactgattttttttcaatcattgtaaacgttgcatttgtatgcagatctcctgtattttcgagaaaaataa

SEQ ID NO: 5090 - DNA, 1360 bp, Panicum virgatum
ggctccgcccatcgtctccctcggctttcttaagccctccgctccccttctctctcccacaggagtcccaatcaacaaggtcggccatggcgcaggatgattcggttgtttctgctcagtggctgcaccagcacctaggagcgcctgacgttaaggttttggatgcttcctggtacatgccggtagagaacagggatccatgggaagaataccaggtggcacatatccctggtgcgttgttcttcgacatagatggcatagtcgatcagacaactgacttaccacacatgttgccatcagaagaggcttttgcagcagcagtttctgcgctggatataaaaaaccaggataaagttattgtttatgatggaaaaggattcttcagtgcacctcgtgtttggtggatgtttagagtttttgggcacaataaagtttgggtgttagatggaggtttacctcagtggcgagcttcggggtttgatcttggaagtgccaaccctgatgatgcagttgttaaatccaaaactgccaataaggctgttgaaagggtttataatggtgaactgacaaatacaatcacattcaagactgaatttcagcctcatctatattggacactggaaaaggtcgcgcataatgttgctgctaagaattaccaacaagtagatgccagatcaaagggcagatttgatggtgtagcaccagaaccacgggaaggagtaagaagtggacacataccaggaagcaaatgtgttccgttcccagagatgtttgatggtgcaccaaggcttctgtccgctgaagagctgaggcaaaagtttcagcaagcaggaatttctcttgaccaccctattgttgtcagttgtggatctggcgtgactgcctgcatacttgctctggggctctatagaattgggaagcatgatgttccagtttatgatggatcttggacagaatgggaagcacaatcagattctgattacccaatagctaccactgctgctgcttaaaatccccaactctaaagagatgcgaaacagtccatccatcctggagcattcagtttagaatgtcggcaaagatgacatttccatgttacaagctttgcacttaaacaaaggcaaagcttataagggcaagaaatgcccaatatgatctatgttgtcctgtgacagaaagagataaagagaacatgaagcagggacagaaagtgcacccttgcccattcttgtgaccctattgtcagcatcaaacttatggttgacatatactagcgtcattgtatttaccatacagattatcatgctcacgatattgcagctaaatgagttaagcatggcaaattcttgtttttggatca

SEQ ID NO: 5091 - DNA, 1393 bp, Cenchrus ciliaris
  misc_feature (398)..(398): n is a, c, g, or t
  misc_feature (761)..(761): n is a, c, g, or t
  misc_feature (945)..(945): n is a, c, g, or t
  misc_feature (974)..(974): n is a, c, g, or t
  misc_feature (981)..(982): n is a, c, g, or t
catcgtccccttcctcaccgtctcgagccctgccttgcgctgcgccccttctctcctgcctgaatccgaatcaacaaggccaactcacctctagtcttgccttaacggtggctagctgccggcgagcttgggaaggaatctcacccgcgagcttccttttctagctaatccaatccggcggcctcgattcctctgctcgcccgcagcaccgcaggtcggcaatggcgcaggatgacccggttgtttctgctgagtggctgcaccagcacctaggagcgcctgatgttaaggttttggatgcttcctggtacatgccggtggagaacaggaacccatgggaagaataccaggtggcacatatccctggcgcggtgttcttcgacatagatggcatagtngatcggacaactgatttaccacacatgttgccatcagaagaggcttttgcagcagcagttaccgctctggatataaaaaaccaggataaagttattgtttatgatggaaaaggattctttagtgcgcctcgtgtttggtggatgtttagagtttttgggcacaataaagtttgggtgctagatggaggtttacctcagtggcgagcttcagggtttgatctgggtagtgccagccccgaggcagtgctgaaatcaaaggctgccagtaaggctgttgaaagagtctataacagtgaaccgacaaacataatcacatttcagactgaatttcagcctcacctattatggacactggaaaaggtngcacataatgtcactgctaagactttccaacaagtagatgccagatcaaaggccagatttgatggtgtagcgccagaaccacgggaaggagtaagaagtggacacataccaggaagcaaatgtgttccattcccagagatgtttgatggtgcaccaaggcttctctccacagatgagctgagtnaaaaatttcagcaagcaggaatttccttngaccacnncattgttgtcagttgcggatctggtgtaactgcctgcatacttgctctgggactctatagaattgggaagcacaatgttccagtttacgatggatcatggacagaatgggaagcacaatcagattctgattacccaaaagctgccaccactgcttaaatccccaactctgaaaaggcgaaagacagcgcatctatccatactggagcattcagtttagattgtcagcaaagatgacatttccctgtgataagctttgcacttaaacaaaggtgaagcttataggggggcaagaacatgtaaagcaggaacagaaagtgcacccttgccaattcttgtgaccttattgtcaacatcaatttttatggttgacatcaactaatgttatcattccagaaataagcatcaagaca

SEQ ID NO: 5092 - DNA, 1366 bp, Avena sativa
gacaaatatcactgttttgctcggtgaccgctcccctcttggagcccccctcctggtcctccccaccaccaccttcactcgaggaatctcatctcgctcgccttccaatccagttcaccaatcttcagaaacctcggctcttgcagcaggctgctcgggtccaatggcgcaggacgatccagttgtttctgctcagtggctgcagcagcgcctagggcagcctgatatcaaggtattggatgcttcatggtacatgccacaagagagcagggatccatggcaagagtaccaggtggcccatattcctggcgcgctgttcttcgacatagatggcattgtcgatcggacaactgatttgccacacatgctgccatcggaagaggcttttgcagcagcagtttccgcgcttggtataaaaaacactgataaagttattgtttatgatggaaagggtttcttcagtgcaccacgtgtttggtggatgttcagagttcttggacacaatgaagtttgggtcttagatggaggtttacctcagtggcgagcttctggattcaatctgggaagcaactgtcctgatgatatacttctgaaatccaaagctgccaatatagctgttgaaacagcttacaatggtgaattgacaaatgctgccacatttcagactgaatttcaacctcagctattctggacgctggaaaaggtaaaaaacaatgtagctgcccaggctcaccaagtagttgatgcacgagcaaagggcagatttgatggtgtagcaccagaaccaagggaaggggtaagaagtggccatatacctggaactaaatgtgttccattccctgagatgtttgatggcgcaccaatgcttctccctgcagatgagctatccaaaaagtttgaggaagcagggatttcccttgatcatccaattgccgtcacttgtggatctggcgtaactgcatgcatagttgctctggggctctatagaatcgggaagcatgatgttccagtttacgatggttcttggacagaatgggaggctcagccagatagtgattacccaaaagttacttccaccgcctcttaaatcaatcatctgaagtgatgaatgcagctgttgcatcctgcagcattcagctcagattgtcagcacaatgatatttctctgtggcaatctttgcacctaagtcaatacatattgtacaatgggccaatggctagctgataatgaagaaatccgatgccaatcttttgtcgactttaaatctataattggttttatactgaacgttactactgaagaaatattgacttcaaacaacattatgtttcagagttgcaactgtgttgattattatgattgcat

SEQ ID NO: 5093 - DNA, 1326 bp, Avena sativa
gacaaatatcactgttttgctcggtgaccgctcccctcttggtgcccccctcctggtcctccccaccaccaccttcactcgaggaatctcatctcgctcgccttccaatccagttcaccaatcttcagaaacctcggctcttgcagcaggctgctcgggtccaatggcgcaggacgatccagttgtttctgctcagtggctgcagcagcgcctagggcagcctgatatcaaggtattggatgcttcatggtacatgccacaagagagcagggatccatggcaagagtaccaggtggcccatattcctggcgcgctgttcttcgacatagatggcattgtcgatcggacaactgatttgccacacatgctgccatcagaagaggcttttgcagcagcagtttccgcgcttggtataaaaaacactgataaagttattgtttatgatggaaagggcttcttcagtgcaccacgtgtttggtggatgttcagagttcttggacacaatgaagtttgggtcttagatggaggtttacctcagtggcgagcttctggattcaatctgggaagcaactgtcctgatgatatacttctgaaatccaaagctgccaatatagctgttgaaacagcttacaatggtgaattgacaaatgctgccacatttcagactgaatttcaacctcagctattctggacgctggaaaaggtaaaaaacaatgtagctgcccaggctcaccaagtagttgatgcacgagcaaagggcagatttgatggtgtagcaccagaaccaagggaaggggtaagaagtggccatatacctggaactaaatgtgttccattccctgagatgtttgatggcgcaccaatgcttctccctgcagatgagctatccaaaaagtttgaggaagcagggatttcccttgatcatccaattgccgtcacttgtggatctggcgtaactgcatgcatagttgctctggggctctatagaatcgggaagcatgatgttccagtttacgatggttcttggacagaatgggaggctcagccagatagtgattacccaaaagttacttccaccgcctcttaaatcaatcatctgaagtgatgaatgcagctgttgcatcctgcagcattcagctcagattgtcagcacaatgatatttctctgtggcaatctttgcacctaagtcaatacatattgtacaatgggccaatggctagctgataatgaagaaatccgatgccaatcttttgtcgactttaaatctataattggttttatactgaacgttactactgaagaaatattgacttcaaacaacatta

SEQ ID NO: 5094 - DNA, 1763 bp, Sorghum bicolor
gagccctgcctggagcaacacagcgctggacgttttcgcttcagcttggaggcatcgatcggagataaaatccaggccatgaaagtggaaacaaaagcagcttaaatcccactgcagcctcgcgcgttccttgccttgtttgcaacaacttcttgcattgttgcttggttgcttgcgtgcagtgcagctcatcatatcactgcgttgtctgtgctgtgcacccatctcagcctccaggcctttatagcaaagccttcttggccccgtgatagttctagagagagaagcaggcagagaggtgacagcaagaggtgtgtagagagagagagagagagagagagagagagagagagagagagggcggaaggcgtggtgggcatggagagtgaggagggcgccacggtagtgtgtgcccacgcccaccaagaagaagcggcggcggcggcggaggcggcggcggccatgaaggaagcaggaggagggggaaagaggaggaggaagcagcagaggaagcagggagggggcggcggagggaggaagaagtacgcgctggtgagctaccacgagctgccggagtacatgaaggagaacgagttcatcctcaactactaccgctccgagtggcccatcctcaatgccgtgctcagcctcttctcctggcacaacgagaccatcaacatctggacgcaccttcttgggtttatgctgttcttcggcctcaccctggtgcatctcggccagtacttcccccaggtggctgatctgattggacacctctcctggccaatctcaaaggttgctgaaaatgtctccagcaatattggagatgtcctatcaggcgcggccatgttcatccagacgaacccgacgctggtctcctacggcgcggcggtgacgtcgcagacgacgcggtggcccttcttcgtgttcctcgccggcgccatgttctgcctgctgagcagcagcgcgtgccacctgctgtcgtgccactcgcacagcctgaacctgttcctgatccgcctcgactacacgggcatcgcggtgatgatcgtggtgtccttcttcccgcccatctactacatcttccagtgcgagccgcactggcaggtggtgtacctgtcggcgatcacggcggcgggggtgggcacggtgtacgcgctcatgtcccctcgcctcagcgcggcgcggtaccgcgcccaccgcgcgctgctcttcgtcgggatgggcctgtcgggcgtggtgcccgccgtgcacgcggccgccgtgaactggcacgagcccgcccggaacgtcacgctggcctacgagggcgccatggccgtgtcctacctcgtcggcaccgcgttctacctcacccgggtgcccgagcggtggaggcccggcgcgttcgacctggcggggcatagccaccagatcttccacgcgctcgtcatcgccggcgcgctcgcgcactacggcgccgccatcgtgttcctcaaggcccgcgacgagatggggtgcccggccagctaagcgaggattggggagacgaaatcaaaccattttgtttacagctttacttacagcagcagcagcagcaagcaagcaagtgtgcaagcatgattgatcgttaattaccgttggccgttggaatgacagttgattggcgttacagattatattccttctcaatttgtacatagaagaactgaagaagctcatcgagtcatgattgattaatgcattctttcgatcggtttggaatttgcaaaattcgaaagatt

SEQ ID NO: 5095 - DNA, 2438 bp, Sorghum bicolor
tgcagaaatgttcgtactttatatttatggacgatgtaaacacacatgggatttatccgaagtccatatttgtcagttcagatacactctgacctgagaattggaaatttacagttgtctcaaaattggaaatttacagctgctatgtactgtgtcctcactcctcaggcttgggaaagaatacacttccctgccactagcaactagtggcaatctagcatattgaagtttctgtgacattaaaatggtccagtcatcagaattaagtatgccagtgaactctgtcctaataatgttagtactatttgatttccctttttatgttcttatattaaaaccaaaaaagaaagaggattgatgtggggctcttttgaattttccttcccaacaccaacagtgttctcccccagctcttccttctgtgatgaggaccttgacaacagtgtcgatgtgggttgtcctcctgccctacctgtatttgtccatgtccccttcaaagcagaagcagtcatcagtcaggcctctctccctctacccctcgtgtgtgctgcacacattaccacaccagaagatacacaccatcatctcatctcatctcctgcaattatatacgtggccagggccagcgacatgtgagccgagccctgcctggagcaacacagcgctggacgttttcgcttcagcttggaggcatcgatcggagataaaatccaggccatgaaagtggaaacaaaagcagcttaaatcccactgcagcctcgcgcgttccttgccttgtttgcaacaacttcttgcattgttgcttggttgcttgcgtgcagtgcagctcatcatatcactgcgttgtctgtgctgtgcacccatctcagcctccaggcctttatagcaaagccttcttggccccgtgatagttctagagagagaagcaggcagagaggtgacagcaagaggtgtgtagagagagagagagagagagagagagagagagagagagagagggcggaaggcgtggtgggcatggagagtgaggagggcgccacggtagtgtgtgcccacgcccaccaagaagaagcggcggcggcggcggaggcggcggcggccatgaaggaagcaggaggagggggaaagaggaggaggaagcagcagaggaagcagggagggggcggcggagggaggaagaagtacgcgctggtgagctaccacgagctgccggagtacatgaaggagaacgagttcatcctcaactactaccgctccgagtggcccatcctcaatgccgtgctcagcctcttctcctggcacaacgagaccatcaacatctggacgcaccttcttgggtttatgctgttcttcggcctcaccctggtgcatctcggccagtacttcccccaggtggctgatctgattggacacctctcctggccaatctcaaaggttgctgaaaatgtctccagcaatattggagatgtcctatcaggcgcggccatgttcatccagacgaacccgacgctggtctcctacggcgcggcggtgacgtcgcagacgacgcggtggcccttcttcgtgttcctcgccggcgccatgttctgcctgctgagcagcagcgcgtgccacctgctgtcgtgccactcgcacagcctgaacctgttcctgatccgcctcgactacacgggcatcgcggtgatgatcgtggtgtccttcttcccgcccatctactacatcttccagtgcgagccgcactggcaggtggtgtacctgtcggcgatcacggcggcgggggtgggcacggtgtacgcgctcatgtcccctcgcctcagcgcggcgcggtaccgcgcccaccgcgcgctgctcttcgtcgggatgggcctgtcgggcgtggtgcccgccgtgcacgcggccgccgtgaactggcacgagcccgcccggaacgtcacgctggcctacgagggcgccatggccgtgtcctacctcgtcggcaccgcgttctacctcacccgggtgcccgagcggtggaggcccggcgcgttcgacctggcggggcatagccaccagatcttccacgcgctcgtcatcgccggcgcgctcgcgcactacggcgccgccatcgtgttcctcaaggcccgcgacgagatggggtgcccggccagctaagcgaggattggggagacgaaatcaaaccattttgtttacagctttacttacagcagcagcagcagcaagcaagcaagtgtgcaagcatgattgatcgttaattaccgttggccgttggaatgacagttgattggcgttacagattatattccttctcaatttgtacatagaagaactgaagaagctcatcgagtcatgattgattaatgcattctttcgatcggtttggaatttgcaaaattcgaaagattattctttttatgtaaaaactgaatgcaggcaataga

SEQ ID NO: 5096 - DNA, 1668 bp, Setaria italica
ccatgggagaggaaacgagagcggcttaaatagcacttcaccccctgaaccccttgcgtgtgccttgtttgcaacagcttcttgcaggctttggcttggcttgcagcttccttttcaatccgtgtgtaagctcacagcctcacaccatatcactgtgctgttgtctgtgctgcagcgcagtgtgcgcccatctccagctccaggcctttatagcctagccttttctggccccgtgataattccagagagagaaaggaggacagaggggtgagagagggagagagagctgagaaggcatggccatggagagtagtgaggagggagccacactttgtggccaccaagaagcggcggcggcggcggcggccgtgaagggaggaggagggggcaagaggaggaagaaggggcagaggagagggggagaagcaggcggggagaggaagaagtacaagctcgtgagctaccacgagctgccggactacatgaaggagaacgagttcatcctcaactactaccgctccgagtggcccatcctcaatgccgtcctcagcctcttctcctggcacaacgagaccatcaacatctggacgcatctccttggcttcatgctgttcttcggcctcaccctggtgcatcttggccagtacttcccccaggttgctgatctgattgggcacctttcctggccaatctcaaaggttgctgaaaatgtctccagcaatatcggggatgtcttatcgggtgcggcgatgttcatccagacgaacccgacgctggcgtcgtacggcacggcggtggcgtcgcagacgacgcggtggcccttcttcgtgttccttgccggcgccatgttctgcctgctgagcagcagcgcgtgccacctgctgtcgtgccactcccaccggctgaacctgttcctgatccggctcgactacacgggcatcgccgtcatgatcgtggtctccttcttcccgcccatctactacatcttccagtgcgagccgcggtggcaggcggtgtacctgtcggcgatcacggcggcgggcgttggcacggtgtacgcgctcatgtccccgcggctgagcgccgcccggtaccgcgcccaccgcgcgctgctgttcgtcgggatgggcctgtcgggcgtggtgccggcggcgcacgcggccgccgtgaactggcacgagcctgcccggaacgtgacgctggcgtacgagggtgccatggcggcgtcgtacctggtcggcacggcgttctacctgagccgggtgcccgagcggtggaggcccggggcgttcgacctcgccggccacagccaccagatcttccacgcgctcgtcatcgccggcgccctcgcacactacggcgccgccatcgtgttcctcaaggcccgcgacgagatgggatgcccggcaaagtgaccgggagctagcgcatggagtggaaaaggattcgttttgtttacagcggctttacttacagttacagcagcaagtgtgcaatattagtcttgttaccgtccgatgaatgacagttgattggaatttttacagattcgttctcaatttgtacatagaagaagcttatgattgagctaatagattctttgtcggcttgaagatcctgcaaaattgcaaatccaaatgtttttcatcaagaggtgatgcaggtaga

SEQ ID NO: 5097 - DNA, 1330 bp, Pennisetum glaucum
agagagagagagagagataggacagaggtgtgtgtgtgtgtgtgagagagagagagctgacaaggctatgtccatggagagtagtgagaagggcgccacaccttgtggccaccaagaaccggcggcggcggcggcggcggcggccgtgaagggaggagggggcaagaggaggaggaaggggcagaggagaggtgcggaagcaggtggggagaggaggaagtacaagctcgtgagctaccaggagttgccggactacatgaaggagaacgagttcatcctcaactactaccgctccgagtggcccatcctcaatgccgtcctcagcctcttctcctggcacaacgagaccatcaacatctggacgcatctccttggcttcatgctgttcttcggcctcaccctggtgcatcttggacagtacttcccccaggttgctgacctgattgggcacctttcctggccaatctcaaaggttgctgaaaatgtctccagcaatatcggggatgtcttatcgggtgcggcgatgttcatccagacgaacccgaccttggcgtcatacggcacagcggtggcattgcagacgacgcggtggcccttcttcgtgttcctcgccggcgccatgttctgcctgctaagcagcagcgcgtgccacctgctgtcgtgccactcccaccgtctgaacctgttcctgatccgcctggactacacgggcatcgccgtcatgatcgtcgtctccttcttcccgcccatctactacatcttccagtgcgagccgcggtggcaggcggtgtacctgtcggcgatcacggcggcaggcgtcggcacggtgtacgcgctcatgtccccgcggctgagcgccgcccggtaccgcgcccaccgcgcgctcctgttcgtcgggatgggcctgtcgggagtggtgccggcggcgcacgcgatggccgtgaactggcacgaacccgcccggaacgtgacgctggcgtacgagggcgccatggcggcgtcgtacctcgtcggcacggcgttctacctgagccgggtgcccgagcggtggcggccgggcgcgttcgatctcgccggccacagccaccagatcttccacgcgctcgtcatcgccggcgcccttgcccactacggcgccgccatcgtgttcatcaaggcccgcgacgagatgggctgcccggccaagtgaccggcaccggagagcgcatggagtggaaaaggattcgttttgtttacagcggatttacttacagttacagcagcagcaaaagtgtgcaatattgatcgtgtcgtttaccgtctgatgaatgatcgtcgttacagattcgtt

SEQ ID NO: 5098 - DNA, 1016 bp, Panicum virgatum
  misc_feature (730)..(730): n is a, c, g, or t
  misc_feature (754)..(754): n is a, c, g, or t
  misc_feature (800)..(800): n is a, c, g, or t
  misc_feature (810)..(810): n is a, c, g, or t
  misc_feature (824)..(824): n is a, c, g, or t
  misc_feature (875)..(875): n is a, c, g, or t
agatctttagcgctcatccattccccctccataagcagaactactagccagccgctctcgtctccacccgcaggttgcggaggccaagttgcagggagggcggagaaacaaactagaaaggatggggcagcagcagcaggtggtgatagtcggggaggagcactgcggcggggaggaccgggagctgacggtgcggaagacgacgctattcacgccgggggacgggctggaggcgtacgaccaccggacgggggcgctggcgttccgcgtggagacctacgggcgcggcggggcgtgcgggggcggggccgcggcgggggacctcgcgctgctggacgccgagggggagcccgtgctcacggtgcgccgccgccgccccagcctgcacaaccgctgggacggcttcctcggggacggcgccgccgcgggcgggggcggccaccagaagcccctcttctccgcgcgccgctcctccatcctcggggccgggaccggcgccgccgccgtcctcgtcgacctcctcgcgcccggcgccaccggggagttccacgtcgacgggtccttcccgcgccggtgctgccgcgtcgtggcctccgccagggcctggggcggcgccgacggcgaggcggaggaggacgtggtggtggcggaggtgcggcggaaggtggacgaggacgcgcacgtggtgatggggcgggacgtgttcgtgctctgggtgcgcgccggcttngacgccgccttcgccatggggatngtcctcgtgctcgaccggatcaccggggacgaggtcgacggagatntaggagaggnccccctcgaggccncctcgccggcgtaagctttgcctggagctcccgctcgcgtgctccgcctcngcgtgatgtagtagcacactttacaaatactactacttctttggtgcttcgtttttttcgtccaagtttggatttttcatttctggcttgtgaatcgagcttgttgtacctttgagcatgatgtgaattatcctttgacgg

SEQ ID NO: 5099 - DNA, 1079 bp, Setaria italica
cgcgaaagcgaacgccgagatcttaaggcttcctcataaataaccaaactactagccgtctaggctctagccccccgccgctagctccccggcacagcgctatccaccggcgtgcagcacgctgagtcggaggccaggttgcagagaggcaggcgagagcaggggaggggagggagggatggggcagcagcaggtggtgatagtgggggaggagcactgcggcggggaggaccggaagctgacggtgcggaagacgacgctcttcaagccgggggacgggctggaggcgtacgaccaccggacgggggcgctggcgttccgcgtcgagacatacgggcgcggcggggagtgcgggggcggggccgcggcgggggacctcgcgctgctggacgccgagggggagcccgtgctcacggtgcgccgccaccgccccagcctgcacaaccgatgggacggcttcctcggggacggcggcgccggccacggccaccagaagcccctcttctccgcgcgccgctcctccatcctcgggcacgggacgggcgccgccgccgtcctcgtcgacctcctcgccccgggcgccacgggcgagttccacgtcgacgggtcgttcccgcgccggtgctgccgcgtcgtggcctccaaggcctggggcgcgagcgagggaggcggcaaggaggaggaggaggacgtggtggtggcggaggtgaggcggaaggtggacgaggacgcgcacgtggtgatggggcgggacgtgttcgtgctctgggtgcgcgccggcttcgacgccgccttcgccatggggatcgtgctcgtgctcgaccggatcaccggggacgaggtcgacggcgacctcggagaggacctcttcgaggccacctcgccggcgtagcctcgccggagctcccgctcgcgtgctctgcgtgatgtagtggtagcacaatttacaaatacttctgtgatgcttcttcttcatcatcatcgaagtttggatctctggcttgtgaattgagcttgttgtacctttgagcacgatgtgaattatcttgacaatttggtgcctcatttttcttcccatt

SEQ ID NO: 5100 - DNA, 1101 bp, Setaria italica
gcagagaggcccgcgagggcgacgcgaaagcgaacgccgagatcttaaggcttcctcataaataaccaaactactagccgtctaggctctagccccccgccgctagctccccggcacagcgctatccaccggcgtgcagcacgctgagtcggaggccaggttgcagagaggcaggcgagagcaggggaggggagggagggatggggcagcagcaggtggtgatagtgggggaggagcactgcggcggggaggaccggaagctgacggtgcggaagacgacgctcttcaagccgggggacgggctggaggcgtacgaccaccggacgggggcgctggcgttccgcgtcgagacatacgggcgcggcggggagtgcgggggcggggccgcggcgggggacctcgcgctgctggacgccgagggggagcccgtgctcacggtgcgccgccaccgccccagcctgcacaaccgatgggacggcttcctcggggacggcggcgccggccacggccaccagaagcccctcttctccgcgcgccgctcctccatcctcgggcacgggacgggcgccgccgccgtcctcgtcgacctcctcgccccgggcgccacgggcgagttccacgtcgacgggtcgttcccgcgccggtgctgccgcgtcgtggcctccaaggcctggggcgcgagcgagggaggcggcaaggaggaggaggaggacgtggtggtggcggaggtgaggcggaaggtggacgaggacgcgcacgtggtgatggggcgggacgtgttcgtgctctgggtgcgcgccggcttcgacgccgccttcgccatggggatcgtgctcgtgctcgaccggatcaccggggacgaggtcgacggcgacctcggagaggacctcttcgaggccacctcgccggcgtagcctcgccggagctcccgctcgcgtgctctgcgtgatgtagtggtagcacaatttacaaatacttctgtgatgcttcttcttcatcatcatcgaagtttggatctctggcttgtgaattgagcttgttgtacctttgagcacgatgtgaattatcttgacaatttggtgcctcatttttcttcccaaa

SEQ ID NO: 5101 - DNA, 2358 bp, Sorghum bicolor
cagatcccattttgttttgctcgcgttgtttcgaactcacgcaacgcaagcagagcaaccgctgccggccgcgcacggccgcccacccaccagaccagtccagtccaccactgcagcctcccaccgccaccacagcagctgccgcggccgcgcggccggcgaggatgagcggggccgcgctgtgcgcggcgctgacggagctggggttcgacggggaggacccgctggacgcggacgcgctggagtggccgttccagtacgaggaggcgcgcccgctgcttgcctggatctgctcctgcctccgcccctccaacgtcctctccccgtcccacctggcccagtatgaacagctcgtggaagagggaagactgttagagggtgaagatttggactctgcttttgatagtatttcagcattttcaagcaagaaagataatcaagaggctgtgtttggattggaagaaaccattcttgatatccgtgaagcaaaactagcatatagagccgaagtttttgagttacaaaagcagcttgcacggcagcaagcacaatttgatttgcttgcaggccaggcttcaactcttattcaaggtagaagggcacgtgtatctgctatgtctgcagttagtggagagcttatatcgttagatgagatactttcttccagaaacttggagatgaatgcagttcttggaagaatcgctgctactacccaggaactggcccattatcattcaggggatgaggaaagtatatatttggcatattcagacttccatccctatgttgttggcgacttgtcttgtacgaaagagctaaataggtggttctcaaagcaattcgagaaggggccatttcgacttgttgctgaggaggggaaatccaaatgttcctgggttagtcttgatgacatcactaattgcttgataagaggagattctgaaaaatctcatcatcaccaacgcgtcgctgagttgcaacgacttcgttccatatttgcaacaagtgaaagacagtggattgaagcacaggttgagaatgctaaacagcaggctatactctctatattgaaagcacaagtgtcatccgacgaggctcatatacatagggatatccattctcttaggagaaaaggttctgagcttgctggagagctctcaacactttctcaaaaggtgcaagctttggtatctgagacaataccatgcctgtgttcagaacttgctcaacttcaaggcacatatatattgcaaggggattatgatttaaaggtcatgcgccaggagtactacattaacaggcaaaaaacgttcatcaatcatttggttaatcagcttgccagacaccagtttctaaagatcgcttgccaacttgaaaggaagaatatagctagagcgtactcattgcttagagtaatagaatctgaattacaaagctacctctcagcagtcaatacccgcttgggtcattataattcattaattcaagctgcatctgaagtacgagagcaaggagctattgatgatcgtgacactttcctccatgcagtgcgagatctcctatgcattcactcaaatgtccaagcaacagtgccaacatatatgtcagcacatgcattggttcagcagatatcagcacttcaatctgacttgctttctcttcagtctgagctggagaacacccttccagctgaccggaaaagatgtatcaatgagttatgtactctgattcaaacagtggaacagcttctatttgcgtcgtcaactactgcagaaccaatattgacgccttggccattgatgcgggcacttgatgatatggaaaatgccaacgctcaagttgaagtttctgtggaagaagtaaccaaggctcgcacccagaagataaagatctttgaaaatcgtgcccacgaggtggggagggagcgacaaatatttgttgatttcttctgcaaccctgagcgcctcaagaatcaagtcagagagctgacctcccgtgtgaaagctctccaggactagacctgttcttgtacgctggtctcacatgtcgtgctgcttttttttttgtgtaaagtttgacttcgctccaacatcaagttggggctgctgtgcagagacggtatggaacaatagaccaggtagctcggggggttcattcaggctctaggtccttgtgccacccggataggatggcattgttgtgatactatttatagcgatctgtatgttgtaaaatatgtcagaaatcacgagccctttctttcgtgtatgattgcttgtgtgatggtggttgtgcagttatggcgtccaaagcacaattggtattgtagcagatcgatttcctctcggcgctgctctg

SEQ ID NO: 5102 - DNA, 2444 bp, Setaria italica
cagatccattttcctttgctcgcgttgtttcgaactcacgcaacgctccacacctgccgctgccggccgcgcacggccgcccccccgcccacccactaggccactgcagcctcccaccgccgcagccgctgacgacggcgaggatgagcggggcggcgctgtgcgcggcgctgacggagctggggttcgatggggaggacccgctggacgcggacgcgctggagtggccgttccagtacgaggaggcgcgcccgctgctcgcctggatctgctcctgcctccgcccctccaacgtcctctccccatcccacctcgcgcagtatgaacaacttgtggaagagggaagactgttagagggtgaagatttggactctgctttcgatagtatttcagccttttcgagcaagaaagacaaccaagaggcagtgtttggatcagaagaaaccattcttgatatccgcgaagcaaaactagcatatagagccgaagtttttgagttacagaagcagcttgcacggcagcaagcacagtttgatttgcttgcaggccaagcttctactcttattcaaggtagaagggcacgtgtatctgctatgtctgcagttagtggggaactagtatcgttagatgagatactttcttccagaaacttggagatgaatgcagttcttggaagaattgcggctactacccaggaactggcccattatcattcaggcgatgaggaaagtatatacttggcatattcggacttccacccctatgttgttggcgacttggcttgtacgaaacagctaaataagtggttctcaaagcaatttgagaaggggccatttcgacttgttgcagaggaggggaaatccaaatgttcctgggttagtcttgatgacatcactaattgcttgataagaggagattctgaaaaatctcatcatcaccagcgtgtagctgagttgcaacggcttcgttccatatttgctacaagtgaaagacagtggattgaagcacaagttgagaatgctaaacagcaagccatactctctatattgaaagctcaagtgtcatccgacgaggctcatatacatagggacatccattctctcaggagaaaaggttctgagcttgctggagagctctcaacactttctcaaaaggtgcaagcttttgtatctgagacgataccatgcctctgttcagaacttgctcaacttcaaggcacatatattttgcaaggggattatgatttaaaggtcatgcgccaggagtactacattaacaggcaaaagacgttcatcaatcacttggttaatcagctcgccagacaccagtttctgaagattgcttgccaacttgaaaggaagaatatagctagtgcttactcattgcttcgagtaatagaatctgagctccagagctacctctcagcagtcaatacccgtttgggccattataattcattaattcaagctgcatctgatgtaagagaacaaggagcaattgatgatcgtgacactttcctccatgcagtgcgagatctcctatgtattcactcaaatgtccaagcaacagtgccaacatacatgtcagcacatgcattggttcagcagatatcagctcttcaatctgacttgctttctcttcagtctgagctggagaatacccttccagctgaccggaaaagatttatcaatgagctatgcactctgattcaaactgtggaacagcttttgtttgcatcatcaacaactgcagaaccgatattgacaccttggccactgatgcgggcgcttgatgatatggaaaatgcaaacgctcaagttgaagtttctgtggaagaagtaacaaaggctcgcacccagaagataaagatcttcgagaatcgtgctcatgaggtggggagggagaggcaaatattcgttgatttcttctgcaaccccgagcgcctcaagaatcaagtccgagagctgacctcccgcgtgaaagctctccaggactagactttttttttttgcaggctggaaagtacaggacgtgtctcatgtgccgcgatatgttttgtgtaaagtttggctttgctccaagtccaacatgaagttggggctgctgtgcagggacggtatggaacaatatagaccatcaggtagtttagtgattcaggttctaaggtccttgtgccgcccggcaaggatggcgctgttgtgatattatttattagtgatctgtatgttgtaaaatatgtcagaaaccacgagctccttctttcgtgtatgattgcacttgagtaggttgaggtggtagtgcatttgtggtgtgcaaagaacaatcgatgctgtagtttgggtaaatggaatcgtccttcactcgcaggggggtgcgatgaagtgataatcccctcccaaccattgggtgaaattgacaggaaagttgggctcttttttcacttc

SEQ ID NO: 5103 - DNA, 2339 bp, Panicum virgatum
gccgcctccccgcccacccactacaggttcccaccgccgcagccgccgacgacgaaggcggtgaggatgagcggggctgcgctgtgcgcggcgctgacggagctggggttcgacggggaggacccgctggacgcggacgcgctggagtggccgttccagtacgaggaggcgcgcccgctgctcgcctggatctgctcctgcctccgcccctccaacgtcctctccctatcccacctcgcacagtatgagcaactcgtggaagagggaagattgctagagggtgaagatttggactctgcctttgatagtatttcagccttttcaagcaagaaagacaaccaggaggctgtttttggatccgaagaaaccattcttgatatccgcaaagcaaaactagcatatagagctgaagtttttgagttacagaagcagcttacacgacagcaagcacagtttgatttgcttgcaggccaagcttctactcttattcaaggtagaagggcacgtttatctgctatgtctacagttagtggacaactactatcattagatgagatactttcttccagaaacttggagatgaatgcagttcttggaagaatcgccactactactcaggaactggcccattatcattcaggggatgaggaaagtatatacttggcatattcagatttccacccttatgttgttggcgacttggcttgcacaaaagagctaaatcggtggttttcaaagcaattcgagaagggtccatttcgacttgttgctgaggaggggaaatcgaaatgttcctgggttagtcttgatgacatcactaattgcttgatgagaggagattctgaaaagtctcatcatcatcaacgtgtggctgagttgcagcgacttcgttccatatttgctacaagtgaaagacagtggattgaaggacaagttgagaatgctaaacaacaggcaatactttcaatattaaaatcacaagtctcatcagatgaggctcatatacatagggacatccattctcttaggagaaaaggttctgagcttgctggagaactctcgacactttcacaaaaggtgcaggcttttctatctgagacgataccatgcctctgttcagaacttgctcaacttcaaggcacatatattttgcaaggggattatgatttaaaggtcatgcgccaggaatactatattaacaggcaaaagacgttcatcaatcacttggttaatcagctcgccagacaccagtttctgaagattgcttgccaacttgaaaggaagaacatagctagtgcttactcattgcttagagtaatagagtctgagttacagagctacctgtcagcagtcaatacccgtttgggccattataattcattaattcaagctgcatctgaagtaagggaacaaggagcgattgacgatcgtgacactttcctccatgcagcgcgagatcttctatgtattcactcaaatgtccaagcaacagtgccaacatacatgtcggcacatgcattagttcagcagatatcagcacttcaatctgacttgctttctcttcagtctgagctggagaatacccttccagctgacaggaaaagatgtataaatgagctatgcactctgattcaaacagttgaacagcttctgtttgcatcgtcaacaactgcagaaccaatattgacaccttggccactgatgcgggcacttgatgatatggaaaacgccaacgctcaagttgaagtttctgtggaagaagtaaccaaggctcgcacccaaaagataaagatcttcgaaaatcgtgcccatgaggtggggagggagaggcaaatattcattgattttttctgcaaccccgagcgcctcaagaatcaagtcagagagctaacctcccgcgtgaaagctctccaggactagacttttttttctctaagctggtctcacatgacaagcaatatgttttgtgtaaagttttgctccaacataaagttggggttgctgtgcagggacgatatggaacaacagtataaaccatcaggtagtggatggtgctgttttggtattatttatttgcgatctgtatgttgtaaaatatttcagaaaccacgagtccaatctttcgtgtatgattgcacttgagtaggttgtggtgtgcaaagatcattagttgatgtagtttggataaatggaatcgaccttcacttgcagggggtctgatgcagtgatggctgatgggttatccgagcaccggagacttgtttggaatctggatacattgtgatcacctatataggtccattgggagaaattgacagaaaaagagtagctcgtttttc

SEQ ID NO: 5104 - DNA, 2519 bp, Oryza sativa
gaaattctctttgtttcgaacgaacgcgacgcgaaaaagcacaccaccactcgcctccgcttcgccgccggccgcgccgcccccaaccaccaccccacccacccacccacccacgcgccgccgcggctgcggctgcggccgccgggagacgcgggcggcggaggttgccgggcgagaggcaggcgagcgagcgagctgctgctgggtttggaatcgggaggagatgagcggcgcggcgctgtgcgcggcgctgacggagctggggttcgacggggaggacccgctggacgcggacgcgctcgagtggccgttccagtacgaggaggcgcggcccctcctcgcctggatctgctcctgcctccgcccctccaacgtcctctccccctcccacctcgcgcagtatgagcaacttgtggaagagggtaggctgctagagggtgaggatttggactctgcttttgatagtatttcagccttttcaagcaagaaagataatcaagaggctgtatttggatcagaagaaacaatccttgatatccgagaagaaaaactagcatacagagctgaggtttttgaattacagaagcagcttgcgcggcaacaagcacagtttgatttgcttgcagggcaagcttctactcttatccaaggcagacgggcacgtgtaactgccatgtctgcagttagtggacaacttatatcattggatgaacaactttcttctagaaacttagagatgaatgcagttctcggaagaatcactgctactacccaggaattggcccattatcattcaggagatgatgaaagtatatacttagcatattcagacttccacccttatgttgttggagacttggcttgtacaaaggagctgaaccgctggttctcgaagcaatttgagaaggggccatttcgacttgttgctgaggaagggaagtccaaatgttcctgggttagtcttgacgacatcaccaatggcttgataagaggagattctgaaaaatcacatcatcaccagcgtgtggctgaattgcaacgacttcgttcaatatttgctacaagtgaaagacagtggattgaggcacaagttgaaaatgctaaacaacaggccatactctcgattttaaaatcacaagtgtcatctgacgaggctcatatacatagggatattcattctcttaggagaaaaggttctgagcttgctggagaactctcgactctttctcaaaaagtacaggcttttgtatctgagactataccatgcctctgctcagaactcgctcaacttcaaggcacatatattttgcaaggggactacgatttaaaggtcatgcgccaggaatactacattaacaggcaaaaaacgttcatcagtcacttggctaatcagctagccagacaccagtttctgaagattgcttgccagcttgaaaggaaaaacatagctagcgcctattcactgcttagagtaatagaatccgagttgcaaagctacctatcagctgtcaatacccgtttgggccattgtacttcattaattcaagctgcgaccgaggtgcgtgagcaaggtgcaattgatgaccgtgacactctcctccatgccgtacgggatctcttatgtgttcactcaaatgtccaagcaacaatgccaacatacatgtcagcgcatgccttggttcagcagatatcagcccttcaatctgatttgctttctcttcagtctgaacttgaaagtgctctgccagccgatcgcaaaagatgtatcaatgaactatgcaccctaattcaaacagtggaacaacttctatttgcatcatcgacgactgcagaaccaatattgacaccttggcctctgatgcgagcactcgatgatatggaaaatgccaacgcacaagttgaagtttctgtggaagaagtaacgaaggctcgcacccaaaagataaagatctttgagaatcgcgctcatgaagttgggagggagaggcaagtgttcgtcgatttcttcagcaaccccgagcgactcaagaatcaagtcagagagcttacctcccgtgtgaaagctctccaggaataaatagatagatagatatccctcgtctagtttgcatttgtgtgccaggtcgtcccgcgaaatgggaagcaacagccaagctcgcaatgatgctgttgcttgcaaagtttcccttcctccaatgcgaagtttgggggaaccatcggttagtttgttggatgttgaggtgcacagctgctgttgttatattttggggatgcagtcgtgattgttgtaaagtaaccacgagcccgtttcgtcgtctgattgatattcaggctagatggtggttgtacatttgtgtactggtgttgggagactcgaaaactagcattgcttagtgtgtatattagattgatcttcaattatttgaacactgctaatgagccctatattagattgatcttcaattaaacactaacatttgatgccaatgtgcgctgtgagggttccttcatatttagac

SEQ ID NO: 5105 - DNA, 2294 bp, Brachypodium distachyon
gatgagcggggcggcgctgtgcgcggtgctgacggagctggggttcgacggggaggacccgctggacgcggacgcgctcgagtggccgttccagtacgaggaggcgcggccgttgctcgcgtggatctgctcctgcctccgcccctccaacgtcctctccccgtcccacctctcacagtacgagcaactcgtggaagagggaagacttctagagggtgaggatttggactctgcttttgatagtatttcagccttttcaagcaagaaagacaaccaagaggctgtctttgaagcagaagaaacaattcttgatattcgtgaagcaaaagtagcatatagggctgaagtttttgagttacagaagcagcttgcacggcaacaagcacagtttgatttgctttcaggacaagcatcttctcttattcaaggcaggcgagcacgtgtatcagctatgtctacagttaacgtgcaacttatatccttagatgagatactttcttccagaaacatagagatgaatgcagttcttggaagaattgctgctacaacccaggaattggcccattatcattccggagatgaggacagtatatacttggcatattcagacttcaacccttatgttattggagatttggcttgtacaaaggagctaaaccggtggttctcgaagcaatttgagaaggggccatttcgacttgttgccgaggagggaaaatccaaatgttcctgggttagtcttgatgacatcacaaattgcttggcaagaggagattctgaaaaatctcatcatcaccaacgtgtggctgagttgcaacgacttcgctccatatttgctacaagtgaacgacaatgggttgaagcacaagttgagaatgctaaacagcaggccatactctcaattttaaaatcacaagtatcatccgatgaggctcacatacatagggatatccattctcttaggagaaaaagttcagagcttgctggagaactatcaacactttctcaaaaggtgcaggctttcgtatctgagaccataccatgcctttgttcagaacttgctcaacttcaaggcacatatattttgcaaggggattacgatttaaaggtcatgcggcaggaatactacattaaccggcagaaaacattcataaaccatttggttaatcagctttcaaaacaccagtttctgaagatcgcttgccaacttgaaaggaagcatatagccagtgcttactcattgcttagagtcatagaatctgagttacaaagctacctaacggctgtcaacacccgtctgggccattataattcattaattcaagctgcatctgaggtgcgtgaacaaggagcaattgatgatcgcgacactttcctccatgcagtgcgagatctattatgtattcactcaaatgcccaagcagcagtgccaacatacatgtcagcacatgctttagttcagcagatatcggcactccaatctgacttactttctcttcagtctgaacttgaaaatacacttccagctgacaggaaaagatgtatcaatgagctgtgcactctgattcaaacagttgaacagcttctgtttgcatcctccacaactgcagaaccagtattaacaccttggccactgatgcgagcgctggatgatatggaaaatgccaatgctcaagttgaagtttctgtagaagaagtaaccaaggctcgcacccaaaagataaagatctttgaaaatcgtgcccatgaggtggggagggaaaggcaggtctttgttgatttcttcagcaaccacgagcgactcaaaaatcaagtcagagagctaacctcccgcgtgaaagctctacaggaatagagctcttctcctaggatggtctttgcgaaaatgggaagcaactgcgatggctcctatgtgcagcaattaatgttgtttcttgtagagctccaacacatagttgggggatgtgtgtgcagtgccggtgcgaaacatcataaaatatcaagtggtttgcatattcaggtcattgaccttgcgccacttgaatagtgggcgttatgatatttatgccgttttgtatgttgtaaaatatgttagaaatcacaagcaagctcagtaggttgtggtggtggtgtttagaaattagaaaacaattgattagttcgcattaagcacttgattgagctgggctcgcatttcatgcgactctctcaaagttgctgtcatgctgtgaaactatgaggttggtttgtgcagaagctacggggtggtgcttgaaattaccagtgctttgtcc

SEQ ID NO: 5106 - DNA, 2473 bp, Brachypodium distachyon
tcccagagctccaattccgcagcagatctcccagtcttttgtttcgaacgcactccactccctaccggctaccgctgccggccgcggccgtccacccactaccaccacagcaaccaccgcggaacagcctccacccgccggcaagctttgactcgaggatgagcggggcggcgctgtgcgcggtgctgacggagctggggttcgacggggaggacccgctggacgcggacgcgctcgagtggccgttccagtacgaggaggcgcggccgttgctcgcgtggatctgctcctgcctccgcccctccaacgtcctctccccgtcccacctctcacagtacgagcaactcgtggaagagggaagacttctagagggtgaggatttggactctgcttttgatagtatttcagccttttcaagcaagaaagacaaccaagaggctgtctttgaagcagaagaaacaattcttgatattcgtgaagcaaaagtagcatatagggctgaagtttttgagttacagaagcagcttgcacggcaacaagcacagtttgatttgctttcaggacaagcatcttctcttattcaaggcaggcgagcacgtgtatcagctatgtctacagttaacgtgcaacttatatccttagatgagatactttcttccagaaacatagagatgaatgcagttcttggaagaattgctgctacaacccaggaattggcccattatcattccggagatgaggacagtatatacttggcatattcagacttcaacccttatgttattggagatttggcttgtacaaaggagctaaaccggtggttctcgaagcaatttgagaaggggccatttcgacttgttgccgaggagggaaaatccaaatgttcctgggttagtcttgatgacatcacaaattgcttggcaagaggagattctgaaaaatctcatcatcaccaacgtgtggctgagttgcaacgacttcgctccatatttgctacaagtgaacgacaatgggttgaagcacaagttgagaatgctaaacagcaggccatactctcaattttaaaatcacaagtatcatccgatgaggctcacatacatagggatatccattctcttaggagaaaaagttcagagcttgctggagaactatcaacactttctcaaaaggtgcaggctttcgtatctgagaccataccatgcctttgttcagaacttgctcaacttcaaggcacatatattttgcaaggggattacgatttaaaggtcatgcggcaggaatactacattaaccggcagaaaacattcataaaccatttggttaatcagctttcaaaacaccagtttctgaagatcgcttgccaacttgaaaggaagcatatagccagtgcttactcattgcttagagtcatagaatctgagttacaaagctacctaacggctgtcaacacccgtctgggccattataattcattaattcaagctgcatctgaggtgcgtgaacaaggagcaattgatgatcgcgacactttcctccatgcagtgcgagatctattatgtattcactcaaatgcccaagcagcagtgccaacatacatgtcagcacatgctttagttcagcagatatcggcactccaatctgacttactttctcttcagtctgaacttgaaaatacacttccagctgacaggaaaagatgtatcaatgagctgtgcactctgattcaaacagttgaacagcttctgtttgcatcctccacaactgcagaaccagtattaacaccttggccactgatgcgagcgctggatgatatggaaaatgccaatgctcaagttgaagtttctgtagaagaagtaaccaaggctcgcacccaaaagataaagatctttgaaaatcgtgcccatgaggtggggagggaaaggcaggtctttgttgatttcttcagcaaccacgagcgactcaaaaatcaagtcagagagctaacctcccgcgtgaaagctctacaggaatagagctcttctcctaggatggtctttgcgaaaatgggaagcaactgcgatggctcctatgtgcagcaattaatgttgtttcttgtagagctccaacacatagttgggggatgtgtgtgcagtgccggtgcgaaacatcataaaatatcaagtggtttgcatattcaggtcattgaccttgcgccacttgaatagtgggcgttatgatatttatgccgttttgtatgttgtaaaatatgttagaaatcacaagcaagctcagtaggttgtggtggtggtgtttagaaattagaaaacaattgattagttcgcattaagcacttgattgagctgggctcgcatttcatgcgactctctcaaagttgctgtcatgctgtgaaactatgaggttggtttgtgcagaagctacggggtggtgcttgaaattaccagtgctttgtcctgcgttttcggctcccagttca

SEQ ID NO: 5107 - DNA, 2201 bp, Sorghum bicolor
cagatcccattttgttttgctcgcgttgtttcgaactcacgcaacgcaagcagagcaaccgctgccggccgcgcacggccgcccacccaccagaccagtccagtccaccactgcagcctcccaccgccaccacagcagctgccgcggccgcgcggccggcgaggatgagcggggccgcgctgtgcgcggcgctgacggagctggggttcgacggggaggacccgctggacgcggacgcgctggagtggccgttccagtacgaggaggcgcgcccgctgcttgcctggatctgctcctgcctccgcccctccaacgtcctctccccgtcccacctggcccagtatgaacagctcgtggaagagggaagactgttagagggtgaagatttggactctgcttttgatagtatttcagcattttcaagcaagaaagataatcaagaggctgtgtttggattggaagaaaccattcttgatatccgtgaagcaaaactagcatatagagccgaagtttttgagttacaaaagcagcttgcacggcagcaagcacaatttgatttgcttgcaggccaggcttcaactcttattcaaggtagaagggcacgtgtatctgctatgtctgcagttagtggagagcttatatcgttagatgagatactttcttccagaaacttggagatgaatgcagttcttggaagaatcgctgctactacccaggaactggcccattatcattcaggggatgaggaaagtatatatttggcatattcagacttccatccctatgttgttggcgacttgtcttgtacgaaagagctaaataggtggttctcaaagcaattcgagaaggggccatttcgacttgttgctgaggaggggaaatccaaatgttcctgggttagtcttgatgacatcactaattgcttgataagaggagattctgaaaaatctcatcatcaccaacgcgtcgctgagttgcaacgacttcgttccatatttgcaacaagtgaaagacagtggattgaagcacaggttgagaatgctaaacagcaggctatactctctatattgaaagcacaagtgtcatccgacgaggctcatatacatagggatatccattctcttaggagaaaaggttctgagcttgctggagagctctcaacactttctcaaaaggtgcaagctttggtatctgagacaataccatgcctgtgttcagaacttgctcaacttcaaggcacatatatattgcaaggggattatgatttaaaggtcatgcgccaggagtactacattaacaggcaaaaaacgtgtcttcagggtcattataattcattaattcaagctgcatctgaagtacgagagcaaggagctattgatgatcgtgacactttcctccatgcagtgcgagatctcctatgcattcactcaaatgtccaagcaacagtgccaacatatatgtcagcacatgcattggttcagcagatatcagcacttcaatctgacttgctttctcttcagtctgagctggagaacacccttccagctgaccggaaaagatgtatcaatgagttatgtactctgattcaaacagtggaacagcttctatttgcgtcgtcaactactgcagaaccaatattgacgccttggccattgatgcgggcacttgatgatatggaaaatgccaacgctcaagttgaagtttctgtggaagaagtaaccaaggctcgcacccagaagataaagatctttgaaaatcgtgcccacgaggtggggagggagcgacaaatatttgttgatttcttctgcaaccctgagcgcctcaagaatcaagtcagagagctgacctcccgtgtgaaagctctccaggactagacctgttcttgtacgctggtctcacatgtcgtgctgcttttttttttgtgtaaagtttgacttcgctccaacatcaagttggggctgctgtgcagagacggtatggaacaatagaccaggtagctcggggggttcattcaggctctaggtccttgtgccacccggataggatggcattgttgtgatactatttatagcgatctgtatgttgtaaaatatgtcagaaatcacgagccctttctttcgtgtatgattgcttgtgtgatggtggttgtgcagttatggcgtccaaagcacaattggtattgtagcagatcgatttcctct

SEQ ID NO: 5108 - DNA, 2487 bp, Oryza sativa
acaccaccactcgcctccgcttcgccgccggccgcgccgcccccaaccaccaccccacccacccacccacccacgcgccgccgcggctgcggctgcggccgccgggagacgcgggcggcggaggttgccgggcgagaggcaggcgagcgagcgagctgctgctgggtttggaatcgggaggagatgagcggcgcggcgctgtgcgcggcgctgacggagctggggttcgacggggaggacccgctggacgcggacgcgctcgagtggccgttccagtacgaggaggcgcggcccctcctcgcctggatctgctcctgcctccgcccctccaacgtcctctccccctcccacctcgcgcagtatgagcaacttgtggaagagggtaggctgctagagggtgaggatttggactctgcttttgatagtatttcagccttttcaagcaagaaagataatcaagaggctgtatttggatcagaagaaacaatccttgatatccgagaagaaaaactagcatacagagctgaggtttttgaattacagaagcagcttgcgcggcaacaagcacagtttgatttgcttgcagggcaagcttctactcttatccaaggcagacgggcacgtgtaactgccatgtctgcagttagtggacaacttatatcattggatgaacaactttcttctagaaacttagagatgaatgcagttctcggaagaatcactgctactacccaggaattggcccattatcattcaggagatgatgaaagtatatacttagcatattcagacttccacccttatgttgttggagacttggcttgtacaaaggagctgaaccgctggttctcgaagcaatttgagaaggggccatttcgacttgttgctgaggaagggaagtccaaatgttcctgggttagtcttgacgacatcaccaatggcttgataagaggagattctgaaaaatcacatcatcaccagcgtgtggctgaattgcaacgacttcgttcaatatttgctacaagtgaaagacagtggattgaggcacaagttgaaaatgctaaacaacaggccatactctcgattttaaaatcacaagtgtcatctgacgaggctcatatacatagggatattcattctcttaggagaaaaggttctgagcttgctggagaactctcgactctttctcaaaaagtacaggcttttgtatctgagactataccatgcctctgctcagaactcgctcaacttcaaggcacatatattttgcaaggggactacgatttaaaggtcatgcgccaggaatactacattaacaggcaaaaaacgttcatcagtcacttggctaatcagctagccagacaccagtttctgaagattgcttgccagcttgaaaggaaaaacatagctagcgcctattcactgcttagagtaatagaatccgagttgcaaagctacctatcagctgtcaatacccgtttgggccattgtacttcattaattcaagctgcgaccgaggtgcgtgagcaaggtgcaattgatgaccgtgacactctcctccatgccgtacgggatctcttatgtgttcactcaaatgtccaagcaacaatgccaacatacatgtcagcgcatgccttggttcagcagatatcagcccttcaatctgatttgctttctcttcagtctgaacttgaaagtgctctgccagccgatcgcaaaagatgtatcaatgaacttgtttcttctgatctaagcaaacctacccacattcttggtttagtgaatagaacagtagtgtcccatgttgttaaggcggtaaggcatcctaactcctggcagtccataggcagtatgcctctgatgcgagcactcgatgatatggaaaatgccaacgcacaagttgaagtttctgtggaagaagtaacgaaggctcgcacccaaaagataaagatctttgagaatcgcgctcatgaagttgggagggagaggcaagtgttcgtcgatttcttcagcaaccccgagcgactcaagaatcaagtcagagagcttacctcccgtgtgaaagctctccaggaataaatagatagatagatatccctcgtctagtttgcatttgtgtgccaggtcgtcccgcgaaatgggaagcaacagccaagctcgcaatgatgctgttgcttgcaaagtttcccttcctccaatgcgaagtttgggggaaccatcggttagtttgttggatgttgaggtgcacagctgctgttgttatattttggggatgcagtcgtgattgttgtaaagtaaccacgagcccgtttcgtcgtctgattgatattcaggctagatggtggttgtacatttgtgtactggtgttgggagactcgaaaactagcattgcttagtgtgtatattagattgatcttcaattatttgaacactgctaatgagccctatattagattgatcttcaattaaacactaacatttgatgcc

SEQ ID NO: 5109 - DNA, 2685 bp, Sorghum bicolor
ccgggtgtggcctccatctttatttatgaaagggaggacagggttagctggggcgctgctgacatagctcgcataaataggcaggacccgtggtgctactctcctgtccccttgcggccttccccccctctggagcttggggggtactctgcctcttcttcgtcgtcttggcgtcctccggtgcgcggcctccctgagctggcttcttgttcgcaggagccatggcgaaggaatacccagcttctcccaaagcccagcagctgcaggaatccaagaagcagcgcctgacatacatccttgttgtaagcgcgctctgcattgccttctacgtccttggcgcatggcagaacaccacgcttccaaagcccataggcaactcggggatcacccgggttggctgtgatcccacaactgcctccacgacacagtcctctggctctgtgccgtcgtttgggccaggctccggtgaggtgcttgactttgatgcacaccaccggctcaccatcaacaacacggacggcgatggggaactgcagcagtttccggcatgccctctcaatttcagtgagtacacgccgtgtgaggaccgtaagcgcgggcggcggttcgaccgtgccatgctagtgtaccgggagcgccattgtcctggcaaggacgagcaggtccgatgcctcatcccagcaccgcctgggtacaggacccccttcaagtggcctcatagcagggactacgcctatttcaacaacatcccccacaaggagctcagcattgagaaagcagtgcagaactggatccaggttgagggcgataagttcaagttccctggtggtggcactatgttcccacgtggtgctgatgcctacatagatgatattgataagctcatctcattatcggatggcaagatcaggaccgctgttgacacgggttgtggggttgctagttggggagcttacttgctgaagaggaacatcattgccatgtcatttgcgccaagagacacgcacgaagctcaggtgcaattcgcactggaaagaggtgtccctgccatcattggtgtgatggggaaacaccggttgccttacccatctagggcatttgatatggcacattgctctcgctgtctgattccttggtatgaacatgatgggctataccttgctgaagtcgataggattctaaggccaggaggatattggattctctcgggtcctccaatcaactggaagacgcaccacgtggggtgggagaggacaaaggacgacctcaagcaagagcaagacaatattgaggatatcgcgaggagcctttgctggaacaaagtggttgagaagagggatctctctatctggcagaagcctaagaaccaccttgagtgtgccaacattaagaagacatataagacaccccatatctgcaagagtgacaatcctgatgctgcttggtacagacagatggaagcctgtgttactccattgcctgaagtaagcaaccagggagaagtggcgggaggagcagtggagaaatggccagagagggcattcttagttccccccaggattagaaggggcatgattccaggattggatgcaaagaagtttgatgaggacaagaagttgtgggagaagagggtggcatactacaagcgcatcatacccatagcagagaatagatacagaaatgtgatggacatgaacgcaaacatgggtgggtttgctgcttctttagtgaagtaccctgtgtgggtgatgaatgtcgtccctgttaactctgaccgggacacccttggtgcaatatacgagcgaggcttcattggcacatatcaggactggtgtgaagctttctcaacgtatccaagaacctatgacctcttgcatgctgacaatttgtttagcatctaccaagacaggtgtgatataactgacatcctcttggagatggataggatattaaggcccgagggcacagctatcatccgtgacacagttgacgtgctcacgaaagtccaggcaataaccaagcggatgcggtgggaaagccgcatcatggaccacgaggatggccccttcaatccagagaaggtcctcatggcggttaagacgtactggactgccaaaacggaggaggagcattagcacacaggcgacacggctcactgaaaacctgaaccaggcttgttctaccagttgggaggatggcatcagggttttgccgtctcagtgtagtatgggaccgcctggtcacatgttcctttcacctttctgtaattctttgtagctgcaatcagatgagaagctgagggaggagtttgaggggtgattggacctctagttgatacaggaaaaacggttttgtagcaggggaagaattcgctggtcttgcataggttcctggccctgttccacgaggggttgagctaggttttagtctgtaatatgatggcaccgagcaggcagtgttaccgtatattggagtgacactaatagtaataggtatttattcagttttcctcttaatctgaacactgaagtgcttgaaaattgaaattgaaggttcatttctcatgcaaccagattttggttgttccggcatatagtaccagtcgatggtcgctgctgtggcttcacttgacagattcaaaaggttgttcaatttatcatcttctagcctgaagtctgaacgcac

SEQ ID NO: 5110 - DNA, 2779 bp, Sorghum bicolor
atgaaagggaggacagggttagctggggcgctgctgacatagctcgcataaataggcaggacccgtggtgctactctcctgtccccttgcggccttccccccctctggagcttggggggtactctgcctcttcttcgtcgtcttggcgtcctccggtgcgcggcctccctgagctggcttcttgttcgcaggagccatggcgaaggaatacccagcttctcccaaagcccagcagctgcaggaatccaagaagcagcgcctgacatacatccttgttgtaagcgcgctctgcattgccttctacgtccttggcgcatggcagaacaccacgcttccaaagcccataggcaactcggggatcacccgggttggctgtgatcccacaactgcctccacgacacagtcctctggctctgtgccgtcgtttgggccaggctccggtgaggtgcttgactttgatgcacaccaccggctcaccatcaacaacacggacggcgatggggaactgcagcagtttccggcatgccctctcaatttcagtgagtacacgccgtgtgaggaccgtaagcgcgggcggcggttcgaccgtgccatgctagtgtaccgggagcgccattgtcctggcaaggacgagcaggtccgatgcctcatcccagcaccgcctgggtacaggacccccttcaagtggcctcatagcagggactacgcctatttcaacaacatcccccacaaggagctcagcattgagaaagcagtgcagaactggatccaggttgagggcgataagttcaagttccctggtggtggcactatgttcccacgtggtgctgatgcctacatagatgatattgataagctcatctcattatcggatggcaagatcaggaccgctgttgacacgggttgtggggttgctagttggggagcttacttgctgaagaggaacatcattgccatgtcatttgcgccaagagacacgcacgaagctcaggtgcaattcgcactggaaagaggtgtccctgccatcattggtgtgatggggaaacaccggttgccttacccatctagggcatttgatatggcacattgctctcgctgtctgattccttggtatgaacatgatgggctataccttgctgaagtcgataggattctaaggccaggaggatattggattctctcgggtcctccaatcaactggaagacgcaccacgtggggtgggagaggacaaaggacgacctcaagcaagagcaagacaatattgaggatatcgcgaggagcctttgctggaacaaagtggttgagaagagggatctctctatctggcagaagcctaagaaccaccttgagtgtgccaacattaagaagacatataagacaccccatatctgcaagagtgacaatcctgatgctgcttggtacagacagatggaagcctgtgttactccattgcctgaagtaagcaaccagggagaagtggcgggaggagcagtggagaaatggccagagagggcattcttagttccccccaggattagaaggggcatgattccaggattggatgcaaagaagtttgatgaggacaagaagttgtgggagaagagggtggcatactacaagcgcatcatacccatagcagagaatagatacagaaatgtgatggacatgaacgcaaacatgggtgggtttgctgcttctttagtgaagtaccctgtgtgggtgatgaatgtcgtccctgttaactctgaccgggacacccttggtgcaatatacgagcgaggcttcattggcacatatcaggactggtgtgaagctttctcaacgtatccaagaacctatgacctcttgcatgctgacaatttgtttagcatctaccaagacaggtgtgatataactgacatcctcttggagatggataggatattaaggcccgagggcacagctatcatccgtgacacagttgacgtgctcacgaaagtccaggcaataaccaagcggatgcggtgggaaagccgcatcatggaccacgaggatggccccttcaatccagagaaggtcctcatggcggttaagacgtactggactgccaaaacggaggaggagcattagcacacaggcgacacggctcactgaaaacctgaaccaggcttgttctaccagttgggaggatggcatcagggttttgccgtctcagtgtagtatgggaccgcctggtcacatgttcctttcacctttctgtaattctttgtagctgcaatcagatgagaagctgagggaggagtttgaggggtgattggacctctagttgatacaggaaaaacggttttgtagcaggggaagaattcgctggtcttgcataggttcctggccctgttccacgaggggttgagctaggttttagtctgtaatatgatggcaccgagcaggcagtgttaccgtatattggagtgacactaatagtaataggtatttattcagttttcctcttaatctgaacactgaagtgcttgaaaattgaaattgaaggttcatttctcatgcaaccagattttggttgttccggcatatagtaccagtcgatggtcgctgctgtggcttcacttgacagattcaaaaggttgttcaatttatcatcttctagcctgaagtctgaacgcactattgcttccctggcttggcccatgaacatgttcatctgggtcttctttgtacaatttccccgattctgctgaactcgtcaacaggcaacagcccaagaggatttgacgaaatgccaga

SEQ ID NO: 5111 - DNA, 2577 bp, Pennisetum glaucum
ggcgacagtcagaagagggcagggtatgaaaaaaaggtaacaactcaaaaggagagccttttggttttaccctgcttctactgcaaacaaccatcatgggcgggcaaagctgctcagatcaatggtagagtgggcgacagtcagaagagggcagggcaaatttgctacggtgacaagggaatcctaagatttacaggagccatgccgaaggagtacccagcctcccccaaagcccagcagctgcaggaatccaagaagcagcgcctgacatacatcctcgtggtgagcgcgctctgcatcaccttctatgtccttggtgcatggcagaacactacacttcctaagcccgtaggcaactctgcaatcacccgggttggctgcgaccctgcaaccacgacacagtcctccagctccgcctccgtaccatccttcggaccaggttccggcgaggtgctcgactttgatgcacaccatcggctcaccatcaatgacacagatgccgacgtgggactgcagcagtttccagcatgcccgctcaactttagcgagtacacaccatgtgaagaccgtacacgcgggcgccggttcgaccgtgccatgctggtgtaccgggagcggcactgccccggcaaggacgagcaggtccggtgcctcattccggcaccacctgggtacaggacacccttcaaatggccgaaaagcagggactatgcctatttcaacaatatcccccacaaggaactcagcatcgagaaggctgtgcagaactggatccaggtggagggtgacaagttcaggttccctggtggcggcaccatgtttcctcgtggagctgatgcctacattgatgatatcaataagctcatcccattgtctgatgggcatatcaggactgctgtcgacacaggctgtggggttgctagttggggggcttacttgctgaagaggaacatcattgccatgtcgtttgcaccaagggacacacacgaagctcaggtgcaatttgcactggaaagaggtgtccctgccatccttggtgtgatggggaagcacaggttgccttacccatctagggcatttgatatggcgcattgctcacgctgtctaattccttggtatgcacatgatggactatacctcgctgaagtcgatagaattctaaggccaggaggatattggattctctcgggtcctccaatcaattggaagacgcaccacaacgggtgggagaggaccaaggatgacctcaagcaggagcaagataatattgaggatgttgcaaggagcctttgctggaaaaaggtcattgagaagggggatctctccatctggcagaagcctaagaaccaccttgagtgtgccaacattaagaagacatacaagacaccccatatttgcaagagtgacaatcctgatgctgcttggtacaggcagatggaagcctgtgttactccattgccagaagttagcaaccaaggagaagtggcaggtggagccgtagagaaatggccggatagggcattcatagttccccccaggattagaaggggcatgattccaggattagattcgaagaagtttgatgaggacaagaagttgtgggagaagagaatcgcatactacaagcgcaccatacccatagcagagaatagatacagaaatgtgatggacatgaacgcgaacatgggcgggtttgctgcttctttggtgaagtatcctgtatgggtgatgaatgttgtccctgttaattctgaccgggacacccttggagcaatatatgagcgagggttcattggcacataccaggactggtgtgaagctttctcaacgtatccaagaacctatgacctcctgcatgctgacaatttgtttagcatctaccaagacaggtgcgatataactgacatcctcttggagatggataggatactcaggcccgagggcacagctataatccgtgacacagttgatgtgctcacgaaagtccaggcaataaccaagcgaatgcggtgggagagccgcatccttgaccatgaggacggccccttcaacccagagaaggttctcatggcggtcaagacgtactggactgcagaagcaccagaagatcagcattagcattaggcagttactgaaggctgaatcaggcttgttccgccatctgtgacgatggcatcagggtttcaccatctcggtatgggacctcttggtcacatgattcctttcacttttctctaattctttgcagttccagtcagatgagaagttgagggaggagggtttttggtgtgtggttgggcctctagctatacaggaactggttctgtagcagaggggtggaatgctggtcttgcataggttcctagcccagttcacatgaggggaagaggcgaagagcatagattttagtttgtaatatgatggcaccgaacgagcagctctattgagttaactgaaataggtatttattcaatttgcctctgaactccctagtgctcaaaaattgagatgatcagttgggttctcatgtaaatctcttactagtattcatggctaataaggaggccaacgaagcgg

SEQ ID NO: 5112 - DNA, 2525 bp, Secale cereale
ggctccggtctccctgatcttgcctgggtggtgtctggcatcgcaccacttcactccccactgctcggctcagagtgctcccctgcccgcccgcccccttcgccgtccgtcgttgacgagctcgctcgctcgcgtggataaataaatagcccctgcccggaccggacggagctcgggctcaccggagacggaaggtggcgcgactccttcttctccttcttcctccgttccggcgcgctccgtcctgcccaggagaggaggagggcggcttcttcccgacaggagccatggctaaagattacccagcatctcctaaagcccagcatctgcaagagtccaagaagcagcgtctcacctacgtgcttgtggtgagcgctctctgcgttgccttctacgtgcttggggcatggcagaacaccaccatgccgaatactgtggctgattcggcaatcagtcgagttgactgcgataccgtggcgcagagagacggctcggtgccgtcttttgcgcctgcgtctgagaatgtgctcgattttgatgcgcaccaccagctgaacctcagtgacacggagtctgcggtgcagcagttcccggcgtgctctctcaaccagagcgagtacacgccatgcgaggaccggaaacgtggccgcctgttcgaccgggacatgctgatataccgtgagaggcactgcccgggcaaggacgagcagatccggtgcctcattccggcgccaccgaagtacaagaaccccttcaggtggccggagagcagggacgtcgcttggtttgacaatatccctcacaaggagctcagcatcgagaaggccgtgcagaactggatccgagtggaggggaacaagttccggttccccggtggtggcactatgtttccacatggtgctgacgcgtacattgatgacatcagtaagctcatctcgttgtcggatgggaggatcaggacggcgattgacacgggctgcggggttgctagctttggggcttacttgctgaagagggacatcatcaccatgtcgtttgcaccgagggacacacacgaagctcaggtgcaatttgcactggaacgcggtgtgcctgccatcctcggggtgatgggatcactgcggttgccttatccatctagggcatttgatttggctcattgttcacgctgtctgattccttggggagggcatgatggactgtaccttgccgagatcgatagaattctaaggccagggggctactggattcattcgggccctccaatcaactggaagacgcaccacaatgggtggcagaggaccgaggaagacctcaagcgggagcaagacaagattgaggatgtcgcgaggagcctttgctggaataaggtggccgagaaggaggatctctccatctggcagaagcccaagaaccaccttgagtgcgccgacataaaaaagaagtacaagatgccccatatctgcaagagtgacaatcctgatgctgcctggtacaagaagatggaatcatgtcttactccattgcctgaagtaagcaaccagggatcgatcgctggcggagaggttgcgagatggccaaagagggcactcacggtgcccccaagggttaagaggggcacgattccggggatagatgagaagaagtttgaggatgacatgaagctgtgggagaagaggttggcgtactacaaacgcaccacgcccatcgcacaggggcggtacaggaatgtgatggacatgaacgcgaacttgggcggttttgccgcttccctggttaagtaccctgtgtgggtgatgaacgccgtcccggttaattcggacaaagacacactcggagcaatttacgagcgagggttcatcggcacttaccaggactggtgtgaagccttctcgacgtatccgagaacctacgacctgttgcacgccgacaatttgtttagcatctaccaggacaggtgcgacataacggacatcctcctggagatggacaggatactgaggcccgagggcacggcgatcatccgcgacacggtcgacgtgctcaccaaggtccaggccataggcaagcggatgcggtgggacagccgcatcctggaccacgaggacgggcccttcaacccggagaaggtcctggtggcggtcaagacgtactggacggccgacccatcggagcacagctaagctttacagctctctgagctccgacatggcttgtccggtaaccagccgcgacgcgatgatggcatcggtttcgccatctcggtgtgtgtgtttgtgtagtatgcagtatgtgaccacgtgcgcggtggcttgtttctctctccttttttgtctaattctttgtagttcgggtcgaaatggaaaccaaaaaaatacgtcgagcagatcataggtttttttagcttgtacgaacagagattgttactatgtattactaagattggctaactggaaaaaataggtctttaccaagcgtgcttttgtactggtatagtatagtggcaaaaactccgcgtcctttcg

SEQ ID NO: 5113 - DNA, 2465 bp, Triticum aestivum
ggtcggcatggtccatggtggtctggtctggtctctttgccctggccctgggtggtgtttggcatcacaccacttcactccccaccgctgagagtgctcgcctgcccgccccgctcgccgtcgttgaagagctcgctctcgtcgcgtgaataaatagcgcctcgctgcccggaccggagctcgggctcaccggagacgctcctcctccttcttcttccgtcccggcgcgctgagctcctacccgggagaggagagcagaggagcgcggcttcttcccgacggacaggagccatggctaaagattacccagcatctcctaaagcccagcatctgcaagaatccaagaagcagcgtctcacctacgtacttgtggtgagcgcgctctgcgtcgccttctacgtgctcggggcatggcagaacagcaccatgccgaaccctgtggctgattcggcaataagccgggttgactgtgataccgtggcgcagagagacgggtcggtgccgtcttttgcgcccgcgtctgagaacgtgctcgatttcgatgcgcaccaccagctgaacctcagtaacacggagtccgcggtgcagcagttccctgcgtgcccgctcaatcagagcgagtacacgccatgcgaggaccggaaacgtggccgtctgtttgaccgggacatgctgatataccgtgagaggcactgcccgggcaaggacgagcagatccgatgcctcattccggcgccgccaaagtacaagaaccccttcaggtggccggagagcagggacgtcgcttggtttgacaatatccctcacaaggagctcagcatcgagaaggccgtgcagaactggatccgggtggaggggaacaagttccggttccccggtggtggcactatgtttccccatggcgctgacgcgtacattgatgaaatcagtaagctcatctcgttgtcggatgggaggatcaggacggcgatcgacacgggctgcggggttgctagctttggggcttacttgctgaagaggaacatcattaccgtgtcgtttgcgccgagggacacacacgaagctcaggtgcaatttgcactggaacgcggtgtgcctgccatcctcggcgtgatgggatcaatacggttgccttatccatctagggcatttgacctggctcattgttcacgttgtctgattccttggggagggcatgatggactgtacctcgccgagatcgataggattctaaggccagggggctactggattcactcgggccctccaatcaactggaagacgcaccacaatgggtggaagagggccgaggaagacctcaagcgggagcaagacaagattgaggatgtcgcgaggagcctttgctggaataaggtggccgagaaggaggacctctccatctggcagaagcccaagaaccaccttgagtgtgccgacataaaaaagaagcataagataccccatgtctgcaagagtgacaaccctgatgctgcctggtacaagaagatggaatcctgtcttaccccattgcctgaagtgagcaaccagggatcgatcgccggcggagaggtcgcgagatggccaaagagggcgctcacggtgcccccaagggtcaagaggggcacgattccggggatagacgagaagaagtttgaggaggacatgaagctttgggagaagaggctggcgtactacaaacgcacgacgcccatagcgcaggggcggtacaggaatgtgatggacatgaacgcgaacctgggcggtttcgccgcttccctggtcaagtaccccgtgtgggtgatgaacgtcgtcccggtcaattcggacaaggacaccctcggagcgatctacgagcgggggttcatcggcacctaccaggactggtgcgaagccttctcgacgtacccgaggacctacgacctgttgcacgccgacaatttgttcagcatctaccaggacaggtgcgacataacggacatcctcctggagatggacaggatactgaggcccgagggcacggcgatcatccgcgacacggtcgacgtgctcaccaaggtccaggccatagccaagcggatgcggtgggacagccgcatcctggaccacgaggacgggcccttcaaccaggagaaggtccttgtcgcggtcaagacgtactggacggccgacccgtcggagcacagctgagctgcggctctctgagctccgaaatggcttgtccggtgaccaaccgcgacgcgatgatggcgtcggtttcgccatctcggtgcgtgtgtgtgtgtgtgtgtgtgtgtgtagtaagcagtgtgtgtttctcttgcctttttttgtgtaattctttgtagttcgggtcgaaatggaaaccaaaaaaatacgtcgagcagagcataggttttttcttttagcttgtacgagcagaggttgttatactactaagattgacttactggaaaaataggtctttt

SEQ ID NO: 5114 - DNA, 2562 bp, Triticum aestivum
tggtctggtctctttgccctggccctgggtggtgtttggcatcacaccacttcactccccactccctgctcagagtgctcgcctgcccgccccgttcgccggccgtcgttgaagagctcgctcgcgtgaataaatagcgcctcactgcccggaccggagctcgggctcaccggagacgctcctcctcctcctcctcctccttcttcatccgtcccggcgcgctgagctcctacccaggagaggagaggaggacggcttcttcccgacggacaggagccatggctaaagattacccagcatctcctaaagcccagcatctgcaagaatccaagaagcagcgtctcacctacgtacttgtggtgagcgctctctgcgttgccttctacgtgctcggggcatggcagaacagcaccatgccgaatcctgtggctgattcggcaatcagccgagtcgactgtgataccgtggcgcagagagacggctcggtgccgtcttttgcgcctgcatctgagaatgtgctcgattttgatgcgcaccaccagctgaacctcagtgagacagagtctgtggtgcagcagttccctgcgtgcccgctcaatcagagtgagtacacgccatgcgaggaccggaaacgtggccgtctgtttgaccgggacatgctgatataccgtgagaggcactgcccgggcaaggacgagcagatccgatgcctcattccagcgccaccaaagtacaagaaccccttcaggtggccggagagcagggacgtcgcttggtttgacaacatccctcacaaggagctcagcattgagaaggccgtgcagaactggatccgagtggaggggaacaagttccggttccccggtggtggcactatgtttccccatggcgctgacgcgtacattgatgaaatcagtaagctcatctcgttgtcggatgggaggatcaggacggcgatcgacacgggctgcggggttgctagctttggggcttacttgctgaagaggaacatcattaccgtgtcgtttgcgccgagggacacacacgaagctcaggtgcaatttgcactggaacgtggtgtgcctgccatcctcggggtgatgggatcaatacggttgccttatccatctagggcatttgatctggctcattgttcacgttgtctgattccttggggaggacatgatggactgtaccttgccgagatcgatagaattctaaggccagggggctactggattcactcgggccctccgatcaactggaagacgcaccacaatgggtggaagagggccgaggaagacctcaagcgggagcaagacaagattgaggatgtcgcgaggagcctttgctggaataaggtggccgagaaggaggatctctccatctggcagaagcccaagaaccaccttgagtgtgccgacataaaaaagaagcataagataccccatatctgcaagagtgacaaccctgatgctgcctggtacaagaagatggaatcctgtcttactccattgcctgaagtaagcaaccagggatcaatcgccggcggagaggttgcgagatggccaaagagggcattcacggtgcccccaagggttaagaggggcacgattccggggatagatgaaaagaagtttgaggatgacatgaagctgtgggagaagaggttggcgtactacaaacgcaccacgcccatagcacaggggaggtacaggaatgtgatggacatgaatgcgaacttgggcggttttgccgcttccctggttaagtaccctgtgtgggtgatgaacgtcgttccagttaattcggataaagacacccttggagcaatttacgagcgagggttcatcggcacttaccaggactggtgtgaagccttctcgacgtatccgaggacctacgaccttttgcacgccgacaatttgttcagcatctaccaggacaggtgcgacataacggacatcctcctggagatggacaggatactgaggcccgagggcacggcgatcatccgcgacacggtcgacgtgctcaccaaggtccaggccatagcccagcggatgcggtgggacagccgcatcctggaccacgaggacgggcccttcaaccaggagaaggtcctcgtggcggtcaagacgtactggacggccgacccatcggagcacagctgagctgcagctctctgagctccgaaatggcttgtccggtaactaggagtgacgcgatgatggtgtcggttttcgccatctcggtgtgtgtgtgtgtgtgtgtgtgtgtgtgtgtgtgtgtgtgtgtgtgtgtgtgtagtaagcagtgtgtgaccacgtgcgcagtcgcttgttcctctcgccttttttgtctaattctttgtagttcgggtcgaaatggaaaccaaaaaaatacgtcgagcagatcataggttctttttagcttgtacgaccagagactgttactatgtagtactaagattgacttactggaaaaataggccttttactgagcgtgcttgtgtagtgatatagtggcaaagttctgcgtctttcgagttcaaaaaaaaaa

SEQ ID NO: 5115 - DNA, 891 bp, Zea mays
atgcttctttaaattctgctgccattctgctaccgtgggcgtcgtacagcccccgttcccatagaggacagtctgctgccgcaagcctagcttcgtccacctctgaatcaagaaacaaaacaactaggcatggacgaccgcacctacaagggcggcatcaaggcgtactggaagcgccggggctactaccgcatggacggcgacgccgcgcggcgccgccagccgctccccaccgtggagctcggaggtggcgtcgcccaggcccaggcccaggcccagccgccgacgggggatggctcgggccggcgccggcgccgcgggtggcgcgtgcgccgcggccagctggggcggcggctgctccgcgcgctgtcccctcgccggtggctcatgcggctccgcgacgcgtacgtgtccgccatgctgcggctggcctcctcccccgccgtcgggtacggcgccggcgcgcccttctgcgccacggcgacccacggcgcggcggcggcggcggccttcgcgcggccggcgcagctcaaggagtacgacgagaaggtgctggtggagatctacaggtccatactcgcgcgcggcgggcctctcgccggcgcgcctgccgccgccacgctgcggctaccgacggctgtttgagcttgagcggcagaagagacgtgtgttcttcttgcttatttttattcttatgtgtcgcgacttgtactgagttgtaacttgcgtgcgccccacaagctagcgtttcttcttcgttcccaattcgatatcatcaagtcttatgttatgggcttggagtccaaagtctgtttgtctgctatactagtgcgagtgcatctatagtgaaaatgtttcaatagatgaagaagaacaaaaaaaatgcttggc

SEQ ID NO: 5116 - DNA, 2034 bp, Sorghum bicolor
gaaagcgcaggcgcggggagccggccggaggacaacgacgaggtggacaggctggtcagcggtcactctgctgcctcttgctctccctcttcaggactcctctccaaaggggagagcaaacctctgacaagtgctacaccgtgatccgcataaaaatttctgcgtccgcccgcgcgctccgtgaccgtgagactcggtaactaaaccactcggcactcaccggccgcgaccagcagctcaactatctatccccttcgtctcccaggagtcgagcgagaatggccgccgccgccgcccttcgtcctgctctctcccaagggccagagcacagagcttccctgctgtgcacaccgaagcacagagtttctgccagtgccagcaggagaagcttgagattcaccgctagggccagctcgaatccgggcgcccaggtgagcatcccgaagcaatggtacaacctcatcgccgacctgccggtgaagccgccgccaccactgcacccgcagacacaccagcctctgaatcccagcgatctctcccctctcttccccgacgagctgatcaggcaggaggtcaccgacgagcgcttcgtcgacattcccgaggaggtcatcgacgtctacaagctctggcgcccgacgcccctgatcagggccaggaggctggagaagctgctgggcacgccggcgaagatctactacaagtacgaggggacgagcccggcggggtcgcacaagcccaacaccgccgtgccgcaggcgtggtacaacgccgcggcaggggtgaagaacgtggtcaccgagaccggcgccggccagtggggcagcgcgctgtccttcgccagcagcctcttcggcctcaactgcgaggtgtggcaagtgcgcgcgtcgttcgaccagaagccgtaccggaggctgatgatggagacgtggggcgccaaggtgcacccgtcgccgtcgacggcgacggaggccggcaagaggatcctggaggcggacccgtcgagccccggcagcctcgggatcgccatctccgaggcggtggaggtggcggccaccaacgccgacaccaagtactgcctgggcagcgtgctcaaccacgtcctgctccaccagaccgtcatcggggaggagtgcctggagcagctggcggcgctcggcgagacgcccgacgtcgtcatcggctgcaccggcggcgggtccaacttcggcgggctcgcgttcccgttcctgcgcgagaagctgcgcggcaacatgagccccgcgttcagggccgtggagcccgcggcgtgccccacgctcaccaagggcgtctacgcctacgacttcggcgacacggccggcctcacgccgctgatgaagatgcacaccctcggccacggcttcgtccccgacccgatccatgcaggtgggcttcgctaccatggaatggcacctctgatctcgcacgtctacgagctgggcttcatggatgccattgctatacagcagactgaatgcttccaagctgccctgcaattcgccaggacggagggcatcatcccggcgccggagccgacgcacgcgatcgcggcggcgatcagggaggcgctggagtgcaagcggaccggggaggagaaggtcatcctgatggccatgtgcggccacggccacttcgacctcgccgcgtacgagaagtacctgaggggcgacatggtcgatctctcgcacccggcggagaagctggaggcctccctcgctgccgtgcccaaagtctgatggcgttggagcgaacggcggcacatgcgtactggaatggagcaaatgatccattgagatcaccttcttgaatcttgtggtgatccgtcggcagtggatttggcagctgcgatgatacttgtgttccatatgaaatgaatgaacaaattctcaataaaaggattaatttatcctattgatctttctttttagggtattattattcagtatatatacacttttaagtttcaaacctagacatgaatatatcttttaaaagaaactcagaagcgtctca

SEQ ID NO: 5117 - DNA, 2096 bp, Panicum virgatum
gggagccaccggagctgctggcgtcaccgcctacgagagagagcgccgcccagcggcggcagccgccggggcggtgctcccggttgctggtcagctcagccattgaaagcgcacgcgccgcggacagcgacgcattggatcgcgcgtccggacggtcgatcgtctccctcgccctcccctttcgcctctctcctctcctctgctccagccaagaggaaagagagaaaagaaatccccaggcaagctcttgggaataaaatcacgccgtgatccgcggaagttgcgctgcgcgtgctccatgcggcgctctagttaaatcgctcggccgccagcagccgccggggaggataagattggcacagctaggccgccactcgccactgcccccagaggccagaggcagccagccagtgtgccagttgagttctacgggaatcggaagctgaagacgatggccgccgccacccttcgccctgccctgccccaagcagggccggagcagagagcttcactgctctgcgcgcccaagcacagggtcgccgccggtgggaggactagaagcccgagctttgccgcgagggccagtctgaagagctcgggtgccagggcgagcatccccaagcaatggtacaacctcgtcgccgacctgccggtgaagccgccgccgcagctgcacccgcagacgcaccagcctctagttcccagcgacctgtcgcccctcttcccagacgagctcatccggcaggagctcaccgaggagcggttcgtcgatattcccgaggaggtcatcgacgtctacgagctctggcgcccgacgccgctcatcagggccaagaggctggagaagctgctgggcacgccggcgaagatctactacaagtacgaggggacgagcccggcggggtcgcacaaggccaacaccgccgtgccgcagcgtggtacaacgccgccgccggggtgaggagcgtggtgacggagaccggcgcccgccagtggggcagcgcgctctccttcgccagcagcctcttcgggctcaactgcgaggtgtggcaggtgcgcgcgtccttcgaccagaagccgtaccggcggctgatgatggagacgtggggcgccacggtgcacccgtcgccatcggaggcgacggcggccgggagggcgatcctggcggcggacccgtccagcccgggcagcctggggatggccatctcggaggcggtggaggtggcggccaccagcgccgacaccaagtactgcctgggcagcgtgctcaaccacgtcctgctccaccagaccgtcatcggcgaggagtgccttgagcagctggcggcgctcggcgaggcgccgccggacgtcgtcatcggctgcaccggcggcgggtccaacttcggcgggctcgcgttccccttcatccgcgagaagctcgccggcaggatgagcccggagttccgggccgtggagccagcggcgtgccccacgctcaccaagggcgtctacgcttacgacttcggcgacacggccgggctcacgccgctcatgaagatgcacacgctcggccacggcttcgtccccgaccccatccacgcaggtgggcttcgctaccatggcatggcgcctctgatctcgcacgtgtacgagctcggattcatggaggccatcgccatacagcagaccgaatgcttccaagcggcgttgcaattcgcccggacggagggcatcatcccggcgccggagccgacgcacgcgatcgcggcggcgatccgggaggcgctggagtgcaagaagaccggcgaggagaagatcatcctgatggccatgtgcggccacggccacttcgacctcgcctcgtacgagatgtacctgaggggcgacatggtcgacctgtcgcacccggcggaaaagctggaggcgtcactcgccgccgtgcccaaaatctgaagatgttggccgagagggatagctgcaactgcaactgaaatggaacaaataaacgattgatatcgcgtctcccaaataaaaataatgagatgaatgaataagtttttttaataaatagaacaattttgaagggaatgtttgatatggatttctttttgggt

SEQ ID NO: 5118 - DNA, 2108 bp, Oryza sativa
tgccccagtcaatttccccacgtgccatctcgctgcatccgccgccgtgcttgcgcttgcgattgcagagttgccattgccatcgcattcagttgcgttgatccgatggcgcagtagcaaaaccgagtctcctctcctccctccctccctcccttccctttgccatcaaacgcaagccgggagaagcaccaccacctagatagaacaataaaaattgctgcatccgtcagagctggccactacaaaaaccagctgcatcacaggagagagcaggcagagaggcagctctccagctcgcgtttggggttgaccagttactccggcgaaccgacggcaagccggcgccggcggcgagggtcgtcgggagcggaagagagggagaaagaatggccaccaccgcctccgtccgacctcccctgctccgacaagcagcaggttcagaaaaagcctcactcctttgcaaaccaaagcagagagcttctgtcagaagaagaagcttcactgccagggccagctcgaatcctgtgagcatcccgaagcaatggtacaacctcgtcgccgacctgccggtgaagccaccgccgccgctgcacccgcagacgcaccagccactgaaccctagtgacctgtcccctctcttccccgacgagctgatcaggcaggaggtgaccgaggagcggttcatcgacatcccggaggaggtcgccgaggtttacaagctctggcgcccgacgccgctgatcagggcgaggaggctggagaagctgctgggcacgccggcgaagatctactacaagtacgaggggacgagcccggcggggtcgcacaagccgaacacggcggtgccgcaggcgtggtacaacgccgccgccggggtgaggagcgtggtgacggagaccggcgccgggcagtggggcagcgcgctgtcgttcgcgagcagcctgttcgggctcacctgcgaggtgtggcaggtgcgcgcgtcgtacgaccagaagccgtaccggcggctgatgatggagacgtggggcgccacggtgcacccgtcgccgtcggcggcgacggagtcggggaggaggatcctggaacgcgacccggcgagcccgggcagcctcgggatcgccatctcggaggcggtggaggtggcggcgagggacgccgacaccaagtactgcctcggcagcgtgctcaaccacgtgctgctccaccagacggtgattggggaggagtgcctggagcagctggcggccgccggcgacgtccccgacgtcgtcatcggctgcactggcggcgggtccaacttcggcgggctggtgttcccgttcatgcgcgagaagctcgccggcaggatgagcccggcgttcaaggccgtcgagccggcggcgtgcccgacgctcaccaagggcgtctacgcctacgacttcggcgacaccgccggcctcacgccgctcatgaagatgcacaccctcggccatggattcgtccccgaccccatccatgcaggagggcttcgctaccatggaatggcgccactaatctcccatgtgtatgagcttggattcatggaagccattgccatccaacaaactgaatgcttcgatgctgcgttgaaatttgcgcggacggaggggatcatcccggcgccggagccgacgcacgcgatcgcggcggcgatcagggaggcgatggagtgcaagaggacgggggagaagaaggtgatcctgatggccatgtgcgggcacggccacttcgacctggcgtcctacgagaagtacctgaggggcgacatggtcgacctctcccactccgacgagaagctgcaggaagccctcgccgccgtccccaaaatctgatcaatgcgatacaaaaataatcatcagtaaccaagaagaataatctctgttgttgtgttcttggcatgttgttgttttgccttggcgaccgtgttcatctgctgttgatttagggacgcatatggactgaataaatttgatcaataaatgaagtagtttcccctaataggggaatgtttggcacaactccggatccaacatgttttggggctgggtattctagattcacaagttcatgaatctgaatttacgactatg

SEQ ID NO: 5119 - DNA, 1823 bp, Secale cereale
ggcccgagaagccaccctgcaacgataactacttgcccgacaccactcggcggcaggcacaggcaacccctctctcacagcgcgcgcggttgactactaactgagcagagtagctttcggggcgcgatccaggaagctaggaacggcaagccggcgccgcggcggcggctccatcgtcacgacaagaaatggccaccgcgctccgccttccccagctcccagcagtcccggagcaagcttcctcgcttcatcgcctaccaaagcacagagttgctgtcactgggcgtaggagcttcgccgccagggctggctcgtatccaggcaacgtgggcgtcccgaagcaatggtacaacctcatcgccgacctgccggtgaagccgccgccgatgctgcacccggggacgcaccagccgctgaaccccagcgacctggcccctctgttccccgacgagctcatcaggcaggagctcacggaggagcgcttcatcgacatacccgacgaggtccgggatgtctacgagctctggcgcccgacgccgctcatcagggccaagaggctggagaagctgctcggcacgccggccaagatctactacaagtacgaaggcactagcccggcggggtcgcacaagggcaacaccgccgtgccgcaggcgtggtacaacgccgcggcgggggtcaagaacgtggtcaccgagaccggcgccggccagtggggcagcgcgctctccttcgccagcaccctcttcggcctcaactgcgaggtgtggcaggtgcgcgcgtcgtacgaccagaagccgtaccggaggctgatgatggagacgtggggcgccaaggtgcacccgtctccgtccgacgtgacggaggccggcaggaagctcctggcggcggacccgagcagcccggggagcctcgggatggccatctccgaggcggtggaggtcgcggccaccaacgccgacaccaagtactgcctcggcagcgtgctcaaccacgtcctgctgcaccagaccgtcatcggcgaggagtgcctggagcagctggcggccatcggcgacaccccggacgtcgtcatcggctgcaccggcggcggctccaacttcggcgggctcgccttccccttcatgcgcgagaagctggccggcaggatgaacccgcagttcagggccgtggagcccgcggcgtgccccacgctcaccaagggcgtctacgcctacgactacggcgacacggccgggctgacgccgctgatgaagatgcacaccctcggccacgactttgtccccgatcccatccatgcaggtgggcttcgctaccatggaatggcgcctctgatctcccatgtgtatgagctcgggttcatggaggccatgtccatacagcaaactgagtgcttcgaagctgcaatacaatttgcacggacggagggtatcatcccggcgccggagccgacgcacgcgatcgcggcggcgatcagggaagcgctggagtgcaagaggaccggggaggagaaggtcatcctcatcgccatgtgcggccacggccacttcgacctcgccgcctacgaccggtacctgagaggcgacatgattgatctctcacactccgctgagaagctcaaggagtctctgggtgccattcccaaagtctgatgttagagattcagagattgatagaagaacagtgcgggaagtgggaatacaataagatgaacaatgtgacgctttcttggtgcatggcccaaataaatttgatcaataaaggatgttacctttggctactgacctaaccccaaaaaaaaaaaactagagactcgcacgaca

SEQ ID NO: 5120 - DNA, 1692 bp, Avena sativa
aggtttgactaggaggagcacaatacttaccactcactgaccagagtaggcggctcgctcgtcccgaccgcgatccagggagtgaggtaggcgatcaacggcgaggcgttgccggcggcggcggcgcaggagcagtagaagaaatggccgcctcagcggcccttcgccctccccggctaccagcagtcccagtgccggagcaggcttcttcgctcccttgcttaccgaaaaacagagttgctgtggctggaagaaggagcatcgccactagggccggctcgaatccgggcaacgtcagcatccccaagcaatggtacaacctcgtcgccgacctgccggtgaagccgccgccgtcgctgcacccagggacgcaccagccgctggtccactccgacctggcccctctgttccccgacgagctcatccggcaggagctcacagaggagcggttcatcgacataccccaagaggtccgagacgtctacgagctctggcgcccgacgccgctgatcagggccaagaggctggagaagctgctcggcacgccggcgaagatctactacaagtacgaagggactagtccggcggggtcgcacaaggccaacaccgccgtgccgcaggcgtattacaacgccgcggccggggtgaagaacgtggtgaccgagaccggcgccggccagtggggcagcgccctgtccttcgccagcaccctcttcggcctcaactgcgaggtgtggcaggtgcgcgcgtcgtacgaccagaagccgtacaggaggctgatgatggagacgtggggcgccaaggtgcacccgtcgccgtcggacgtgacggaggccggcaggaagctcctggcggcggacccggccagcccgggcagcctcgggatggccatctcggaggcggtggaggtggcggccacggacggcgacaccaagtactgcctcggcagcgtgctcaaccacgtcctgctgcaccagaccgtcatcggcgaggagtgcctggagcagctggaggccgtcggcgtcaccccggacgtcatcatcggctgcaccggcggaggctccaacttcggcgggctcgcgttccccttcatgcgcgagaagctcgccggcaggatgaacccgcagttcaaggccgtcgagcccgcggcgtgccccacgctcaccaagggcgtctacgcctacgatttcggcgacacggccgggctcacgccgctcatgaagatgcacaccctcggccatggctttgtcccggatcccatccatgcaggtgggcttcgctaccatggaatggcacctctgatctcccatgtgtatgagctcggcttcatggaggccatgtccataaagcaaactgagtgctttcaagcggccttacaattcgcacggacggagggcatcatcccggcgccggagccgacgcacgcgatcgctgcagcgatcagggaagcgctggagtgcaagaggaccggggaggagaaggtcatcctcatcgccatgtgcggccacggccacttcgacctcgccgcctacgaccggtacctgagaggcgacatggttgatctcgcacactccgatgagaagctccaggagtctctggccgatatccccaaagtatgatgctgttagagattggtagaagaacggcgtgggaacataataacaagatgaacaacgtgactgttatttggga

SEQ ID NO: 5121 - DNA, 1812 bp, Triticum aestivum
ggttgactacccactgagcagagcagctttcggggcgcgatccaggaagccaggaacggcaaagcaggcggcgcggcggcggctccatcgtgacgacaagaaatggccaccgccctccgccctccccggctcccagcagttccagagcaagcctcttcacttcatcgcctaccaaagtacagagttgccgtcactgggcgtaggagcttcgccgccagggccggctcgtatccaggcaacgtgggcgtcccgaagcaatggtacaacctcatcgccgacctgccggtgaagccgccgccgatgctgcacccggggacgcaccagccgctgaaccccagcgacctggcccctctcttccccgacgagctcatcaggcaggagctcacggaggagcgcttcatcgacatacccgacgaggtccgggatgtctacgagctctggcgcccgacgccactgatcagggccaagaggctggagaagctgctcggcacgccggcgaagatctactacaagtacgaaggcactagcccggcggggtcgcacaagggcaacaccgccgtgccgcaggcgtggtacaacgccgcggcgggggtcaagaacgtggtcaccgagaccggcgccggccagtggggcagcgcgctctccttcgccagcaccctcttcggcctcaactgcgaggtgtggcaggtgcgcgcgtcctacgaccagaagccgtaccggaggctgatgatggagacgtggggcgccaaggtgcacccgtcgccgtccgacgtgacggaggccggcaggaagctcctggcggcggacccggccagcccggggagcctcgggatggccatctccgaggcggtggaggtcgcggccaccaacgccgacaccaagtactgcctcggcagcgtgctcaaccacgtcctgctgcaccagaccgtcatcggcgaggagtgcctggagcagctggcggccatcggcgacaccccggacgtcgtcatcggctgcaccggcggcggctccaacttcggcgggctcgccttccccttcatgcgcgagaagctggccggcaggatgagcccgcagttcaaggccgtggagcccgcggcgtgccccacgctcaccaagggcgtctacgcctacgactacggcgacacggccgggctgacgccgctcatgaagatgcacaccctcggccacgactttgtccccgatcccatccatgcaggtgggcttcgctaccatggaatggcgcctctgatctcccatgtgtatgagctcgggttcatggaggccatgtccatacagcaaactgagtgcttcgaagctgcattacaatttgcacggacggagggcatcatcccggcgccggagccgacgcacgcgatcgcggcggcgatcagggaagcgctggagtgcaagaggaccggggaggagaaggtcatcctcatcgccatgtgcggccacggccacttcgacctcgccgcctacgaccggtacctgagaggcgacatgattgatctctcacactcctctgagaagctcaaggagtctctgggtgccattcccaaagtctgatgttagagattcagagattgatagaagaacggtgtgggaagtgggaatacaataagatgaacaatgtgacgctttcttggtgcatggcacaaataaatttgatcaataaatggccgaagcataagaatgtttctagaaacttttggaaacgagccgaaagtaaaaagtcgtgtgtaccaaaagccttatcccaaacactttgatgcagttttgtatccttaaggttataaggttcctgattttgtc

SEQ ID NO: 5122 - DNA, 2000 bp, Brachypodium distachyon
acgccgcgccgcgcacgttacagaatgaataggagtaaaagcaaaagaaaaacgctgcgcctggactggactggagcacggccggggagctttattatagttgagcagcacgtacagcagcagcctgcaacatctataaacctgtcgacgccaccaaccgcggcagcagagcgcatcacgcagctcgccgttgactcgcgactgctaccactacttcactccggagtgccgccgattcaggaaggaaggaaggcaacggcaaagggctccggaacggaggagaaatggccgccgcttccatcgcgcttcaccctccacggctccaaggcccagggaaagctgcactccctcctcgcataccaaacaggagcagagtcactgtcagcggtacaaggagcttcgccaccagagccggctcgaatccggggaacgtgagcatcccgaagcaatggtacaacctggtggccgacctgccggtgaagccgccgccgcagctgcacccgcagacgcaccagccgctgaaacccagcgacctgtcccctctcttccccgacgagctcatccgccaggagctcaccgaggagcggttcgtcgacatcccggaagaggtccgcgacgtctacgagctctggcgccccacgccgctcatccgggccaaacgcctagagaaacttctcggcacgccggcgaagatctactacaagtacgaaggcactagcccggcagggtcgcacaaggccaacacggccgtgccgcaggcgttctacaacgccgcggcgggggtgaagagcgtcgtcaccgagaccggcgccgggcagtggggcagcgcgctctccttcgccagcacgctcttcggcctcacctgcgaggtctggcaggtgcgcgcgtcctacgaccagaagccgtaccgaaggctgatgatggagacctggggagccaaggtgcacccttcgccgtcggaggccacggagtccgggcggaagcttctcgcggcggacccgagcagcccgggcagcctcggcatggcgatctcggaggcggtggaggtcgcggccaccaatggggacaccaagtactgcctcggcagcgtgctcaaccacgtgctgcttcaccagaccgtcatcggcgaggagtgcctggagcagctggccgccattggcgacacccctgacgtcgtcatcggctgcaccggcggcggctccaacttcggggggctcgcgttccccttcatgcgcgagaagcttgctggcaggattaacccggtgttcaaggccgtcgagcccgcggcctgcccgacgctcaccaagggggtttatgcttatgactatggcgacacggccgggctcacgccgctcatgaagatgcacacgcttgggcatggctttgtccccgatcccatccacgcaggtgggcttcgttaccatggaatggcacctctgatctctcatgtgtatgagcttgggttcatggaagctatgtccatacagcaaaccgaatgcttcgaagctgccttgcaatttgcgcggacggaggggatcatcccggcgccggagccgacgcacgccatcgcggcggcgatcagagaagcgctggagtgcaagagaacaggggaggagaaggtcatcctcattgcgatgtgcggccacggccacttcgacctcgccgcctacgaccggtacctgagaggcgacatggttgatctgtcgcactcctccgagaagctgaaggagtcgctagccgccattcccaaggtctgatgctacctggagattggcagaagaaatagcaccgtggaaacaaaataagatgaataacgtgacagcttgatgagcctaggcatgtcgggttttatctgctgccaaaattatacagggtgcatggccaaaataaaaccgaatcaataaaagaatttctactgctccctcgatctccaaatatatgccatcctagctctcaaactttgcacccaaaatattttcccaacggtgccatcttgcctt

SEQ ID NO: 5123 - DNA, 1887 bp, Hordeum vulgare
gagtttctctctcactctcacagcccacgcgcgcggttgactactacccactgagcagagcagctttcgcggcgcgatccaggaagccaggaaccgcaagcaggcgccgcggcggcggctccattgcgacggcaagaaatggccaccgcctccaccgcccttcgccctccccggctcccagcagtcgcggagcaagcttctccacttcatcgcctaccaaagaacagagttgttgctgtcaatgtacgtaggagcttcgctgccagggccgggtcgtacccaggcaacgtgggcgtcccgaagcaatggtacaacctcatcgccgacctgccggtgaagccgccgccgatgctgcacccggggacgcaccagccgctgaaccccagcgaccttgcccctctgttccccgacgagctcatcaggcaggagctgacggaggagcggttcatcgacattcccgacgaggtccgcgacgtctacgagctctggcgccccacgccgctgatcagggccaagaggctggagaagctgctgggcacgccggccaagatctactacaagtacgaaggcacgagcccggcggggtcgcacaagggcaacaccgccgtgccacaggcgtggtacaacgcggcggcgggggtcaagaacgtggtgaccgagaccggcgccggccagtggggcagcgcgctctccttcgccagcaccctcttcggcctcaactgcgaggtgtggcaggtgcgcgcgtcgtacgaccagaagccgtaccggaggctgatgatggagacgtggggcgccaaggtgcacccgtcgccgtccgacgtgacggaggccggcaggaggctactggcggcggacccgagcagcccggggagcctcgggatggccatctccgaggcggtggaggtcgcggccaccaacgccgacaccaagtactgcctcggcagcgtgctcaaccacgtcctgctgcaccagaccgtcatcggcgaggagtgcctggagcagctggcggccatcggcgacaccccggacgtcgtcatcggctgcaccggcgggggctccaacttcggcgggctcgccttccccttcatgcgcgagaagctggccggcaggatgaacccgcagttcaaggccgtggagcccgcggcgtgccccacgctcaccaagggtgtctacacctacgactacggtgacacggccgggctgacgccgctgatgaagatgcacaccctcggccacgactttgtccccgatcccatccatgcaggtgggcttcgctaccatggaatggcgcctctgatctcccatgtgtatgagctcgggttcatggaggccatgtccatacaacaaactgagtgcttcgaagctgcaatacaatttgcacggacggagggcatcatcccggcgccggagccgacgcacgccatcgcggcggcgatcagggaagcgctggagtgcaagaggaccggggaggagaaggtcatcctcattgccatgtgcggccacggccacttcgacctcgccgcctacgaccggtacctgagaggcgacatgattgatctctcacactcctccgagaagctcaaggagtctctgggtgccattcccaaagtctgatgtcagagattcagagattgatagaagaacagtgtgggaggtgggaatacaataagatgaacaatgtgacactttcttggtgcatggcccaaataaatttgatcaataagggatgttacctttttgctactgccaccacaattcttgatacattccatcctagtttctaaaatttggttgacaaatatttttctaacttgcatgtactccctctgtaaaataatataaaagcgtttagattactaaagcaatgttttaaatggtcttatatta

SEQ ID NO: 5124 - DNA, 2474 bp, Brachypodium distachyon
cccaactaactaagcgcactgctcatcctctccggctctccctctcgttccctcctctccttcctcagtttcccccgccgccacacacagcaacagcagggacaggacaagtcccgatccccgccgccagcgaagtaccggagagactgtagagcgccgccatatcccgcctccacctcttccccgttccactccatctgctcccgcaatgcccccgtgcttcttcctcgccaccgcgtccttccctcacttcgccgtgctccgcagcgggatgtgcagcctcacaccgaccgcttcctggatggctggaccggatttcggttttgcccttttagatgttaattgatttcggttgtcattgctttgccggtaagcgaaattggagtacaaaataaactgaatagtttcttccgaatgcccagccctagaagagttcagggctattttttccttcttgcaaacggtttgctatttctcgtacgtcggagaaataactatttttttgtcgacgttaacaaccgtcagattcaatcaatcatgagatttgtgtaagattgatgtaagtacacatgacagaaaatcttcgtcggatggctatgattgtcggctgagaaataattatttctatgtcggctgaaaaatagatactcacacttttacaaaaccagccagcgctgcattctaattagcctctttgcaaattcaatcaatgtatttacgacaatgttttgagctgtggacaccatggctcatgttttagactgacataatacgaagggaaaagatgtcaacatcagttgatcataatgctgccaaacagtacacaagaaagaatgagaggagaggatccaacagaacagaggatagggtttgcttgctcccccctccacacaagccaaatacaatacccaacacctaattcttttccctattagcacacactgaaccacaggtttcaggccagagatataccaccatcctcaacaaacaaagtccccctcctcttcttgcttgtacctcgttttataatagcacaggctagcgcagtgtgggggagggcaacagaagggaagagagatggcgccggcaatggcctccctgaagagcagcctcctcttgccatcatcccctctctccgacttcagtggtgcagccctctccatgtcaacccagaataggaggagatcatggcagccaaggggggcaagaatgcaggtggcagcggctgcagactctaagaacattcttgtcatggggggcaccaggttcattggtgtcttcatgtccagactccttgtcaaggagggacatcaggtcacattgttcactagaggaaaggcacccgtaacccagcagttgccaggtgaatcagatgcagagtatgcagagttctcttccaaggtgctacatttgaaaggtgacaggcaagactttgacttcgtcaagacgaacctttctgctaagggcttcgatgtcgtctacgatattaatgggcgtgaggccactgaggtagcccccatactagaggctctgccgaacctggaacagttcatctattgctcctcagcaggagtgtacctgaaatcagacctgctccctcactttgagactgacgcggtggacccgaaaagccggcacaaggggaagctggagacggagagcctgctggagaagagcggtgtgaactggacatcgatcaggccggtgtacatctacgggcccctcaactacaaccccgtggaggagtggttcttccaccggctcaaggccggccggccgatccccatccccggcgccgggaaccaaatcacccagctcggccacgtcaaggatctggccacggcattcatcaaggtcctcggcaaccccgcggccagcaaacaggtgtacaacatctcgggcaccaagtacgtcaccttcgacggcctagccagggcatgtgcaaaggctggagggttccctgagcctgagatcatccactataaccccaaggacttcgatttcggcaagaagaaggccttccccttcagagaccagcatttcttcgcgtcagtggagaaggccagcaaggagctcggattcacgccggagtacgacctcgtcgatggcctgacggactcatacagcctcgacttcggccgcgggacgttcaggaaggaggccgatttcaccacggacgacatgatcctcggcaagaagctcgtcagcgtgtgagaggctagagcacaaggaagacaatctcagttttgggataggttcagtgcttatatgtatattcgcttatccgatgagacgtgtaattgtgtaaagctaacacccagctcgatctctcatttctaaagaaactcatctgaactttgtcgggggctcttattggtggtggatggatggcagtccagaggagcccgagcgcgcggctacagcatttgtgagaacgcacgcacgggagacgttatcaatcggatgttcaagtt

SEQ ID NO: 5125 - DNA, 2837 bp, Brachypodium distachyon
cgatctcctccaacatcatggagccccatccccatgccgccgcgcgggcactcgtcttcctgtccctggcgctcctcgctcacggcaagccaggggacctcaaccgggacagcttccccaagggcttcgtcttcggcacggcctcgtcggcgtaccaggtggaggggaacgccctcaagtatggccgagggccctgcatctgggacaccttcctcaaatttccaggtgctactcctgataacgcgacagccaacgtgacggtcgacgagtaccatcgctacatggatgatgtggacaacatggtgagggtgggcttcgacgcctatcgcttctccatctcctggtcgcgcattttccccagcgggattgggaggattaacaaggacggcgtggattattaccaccggctcatcaactacatgctcgccaacaagatcactccgtatgtcgttctgtaccactacgacctgcccgaggtgctcaacaaccagtacaacggctggctcagccccagagtcgtgagcgactttgggaactttgcagacttctgcttcaagacgtacggggaccgtgtgaagaactggttcaccatcaacgagccccggatgatggcctcccacggctacggcgacggcttcttcgcccccggccggtgcaccggctgccgcttcggcggcaactccgccaccgagccttacatcaccggccaccacctcctcctctcgcacgccgccgccgtcaagatctaccgcgacaagtaccaggcagctcagaaggggaagatcggcatcctgctggacttcgtgtggtacgagccttacaactacacgatcgaggacgagtacgcggcgcacagggccagggagttcaccctcggatggttcctgcacccgatcacctacgggcactacccggagacgatgcagaagatcgtgggggacaggcttcccagcttcagccccgagcagaccgcgctggtgcagggctccgccgactacatcgggatcaaccattacacctcctactacgtcaagcactacgtcaacctcacgcacatgagctacgccaatgactggcaagccaagatctcctacgaccgcaacggcgtgctcataggaaaacaggcgttctccaactggctgtatgtggtgccgtggggattctacaaggcggtgatgcacgtcaaggacaagttcaggaacccggtgatagtgatcggggagaacgggatcgaccaggcggggaacgacacgctgccccacgcgctctacgaccacttcaggatcgactacttcgaccagtacctgcacgagctgaagcgggccatcgacgacggcgccagggtggtcggctacttcgcatggtcgctgctcgacaacttcgagtggcggatgggcttcacctccaagttcggcctcgtctacgtcgaccgcaagaccttcacccgctaccccaaggactccacgcgctggttcaggaagatgatcaagaacgaagaatgaccaccctagctagctgcttgcgtttcttctttcaaatgttaaagggaagagagatggcgccggcaatggcctccctgaagagcagcctcctcttgccatcatcccctctctccgacttcagtggtgcagccctctccatgtcaacccagaataggaggagatcatggcagccaaggggggcaagaatgcaggtggcagcggctgcagactctaagaacattcttgtcatggggggcaccaggttcattggtgtcttcatgtccagactccttgtcaaggagggacatcaggtcacattgttcactagaggaaaggcacccgtaacccagcagttgccaggtgaatcagatgcagagtatgcagagttctcttccaaggtgctacatttgaaaggtgacaggcaagactttgacttcgtcaagacgaacctttctgctaagggcttcgatgtcgtctacgatattaatgggcgtgaggccactgaggtagcccccatactagaggctctgccgaacctggaacagttcatctattgctcctcagcaggagtgtacctgaaatcagacctgctccctcactttgagactgacgcggtggacccgaaaagccggcacaaggggaagctggagacggagagcctgctggagaagagcggtgtgaactggacatcgatcaggccggtgtacatctacgggcccctcaactacaaccccgtggaggagtggttcttccaccggctcaaggccggccggccgatccccatccccggcgccgggaaccaaatcacccagctcggccacgtcaaggatctggccacggcattcatcaaggtcctcggcaaccccgcggccagcaaacaggtgtacaacatctcgggcaccaagtacgtcaccttcgacggcctagccagggcatgtgcaaaggctggagggttccctgagcctgagatcatccactataaccccaaggacttcgatttcggcaagaagaaggccttccccttcagagaccagcatttcttcgcgtcagtggagaaggccagcaaggagctcggattcacgccggagtacgacctcgtcgatggcctgacggactcatacagcctcgacttcggccgcgggacgttcaggaaggaggccgatttcaccacggacgacatgatcctcggcaagaagctcgtcagcgtgtgagaggctagagcacaaggaagacaatctcagttttgggataggttcagtgcttatatgtatattcgcttatccgatgagacgtgtaattgtgtaaagctaacacccagctcgatctctcatttctaaagaaactcatctgaacttt

SEQ ID NO: 5126 - DNA, 1271 bp, Zea mays
cttcccccatttcctcgcagtcgcatcgcatccgccctccttgcttcacacgcgcgacgcgatttttctattctttttttgggtggtagttggccaggtcggcgtagggatggagacggcggccgcggcgatgctggaggccggggtggggcggttctcgcgggcgccggcgatggccgcggcgctgctggcggagatgtgggcgccgctggccgtggcgctagcggcgctggccacgctgcccagcctgctgcgccgcctgcaggtcatcgtcctgcgcctccgctcccgcgggaaggaggccatccagttgcacatggggacctactactcgtcctgcgacgacgacgacgacgacgaggacggcgacgaagacgagagctccgacgacgaggtcgacgccagctcctcgggcgacgacggcgaggatctgaagcgaatcgggttctacgagggggccgcggacggcgtcttcccctggggcggcgccgtagtccggacctggcagggcctcccgcgccgcttcacggcctgcgcgtcgggcgtgggagctgtcggcggcgccagcggaggagcgttccctgccgctgtcaggctgtggggcgccggcacggccagcggccagccgtggtgggcctgcagcgccgatgaaggcggctgccgcgacggcgcggccgcggaggtggaccaggtcgtcgtcgggtggcggcgcgagcacgcgtcgcagcagcggcgccggcggcgtgccgttcccctcgctcacacgggcaactgaaacggaacggaacggcaacgggcaaacgaagttacgaagtgggtgtgtcggatttgtgaatatgctgcaggtcgaccagctggagatgccgattccacgattagggcccacctgtaagtgggtgggacgggcccaggccaatgaataaggaaaagggacggtgagagtgccgggaaggggaaggattggttaggcgccgcgccggattggttggtgacaacattattattttttattagtagtataggaaaggaaaggaaaggaaaagaaaaaaaaactggggctggtgcagacgtttgcactacatgttgtactactacggttactccctgggtgggtgggttagaaatgcgtgatgcagccgcacatcttttacctgtggtgatgactgatgatgtgcaccttgcacgcatgcaacttgtaccgccattctttgattgattcatgtgggatcgaaagagaggaaaatggtgagatctccttgggattgattttt

SEQ ID NO: 5127 - DNA, 3051 bp, Zea mays
aaatggactgcagtcaagatccccaagaagaaagccatcaaagaagggagaatggtgaagaagcagaaaagacggctgactatggaaatgctttgagtcgtaaggaggtaacagaagagcttcttggttgtgtggttcatagtgaggaagaggcgtacaggttgtactgtgattatgggcatcgaatcggttttagcgtgcggaagggcaaacagtcttactttattggtaccaagaatattcgaacaaaggattactactgctcaaaggaagggcttaaatacgatgagcctgttacagaagcaaattttaatcgaccagacacaagaactaattgcaaagcaatgatccgctttagagttgacgagaaggggcggtggacagttatacgctttgttcctgtacataatcaccagttggcaaaacctggagaaagacacatgctgagatcagccaaatcgcttgctgttggcaaatcaggtgttatagatccattagcatctacagaggcacatccaattaatggtttctctgatatgacaggtgatatagttgagaattcagggtatactataagggaatgttacaatcaagtgggcatgcagagtataacagtaattgaggcaggggatagccaaagtcttgtcagctatttcaagcataaaactaatgaggaaggcatgttctattgggacgtccaagttgatcaagaagggcgcatgacgaacttcttctacagggatggtaaaagtagaaatgattatggctgctttggagatgccattatatttgatacaacctaccgcacaaacaaatataacttgatatgcgccccatttgttggtgttgaccaccattggcaaaatgttgtttttggctgcgcgttcttgttagacgagtctgtaacttcctatgcctgggtatttaaatcattcttggagtcaatgggagggcgatcaccaaaatcaatattcactgatcaggatgaagctattatgcaggcagtcaaacaggttttccctaatacgcaacattgtttttcctactggcatattctgaagaatgctcaatctcatttaggctcactaaatacgtctcaagcatttcaaagtatgtttaccaagtgtatgcaaggatctgactcagaagaggattttaaggaatcatggactgcaatgatccaggaatacaagctacaggataataattggttgattgacctttatacattccatcataaatggtgctcggcgtttaacaaagatacatttgatggtggaattaattcttctcagtggggggaggtttcaagtaatattctcaatggaatttctgatgaaaatacctctcttacacgttttgcccttttgctagaaaaggttgtcaaggatctacgtagaaatgaatctgaagaggattttcgatgtagccaaactgctccagtccgtgcaattaagcatagtaccgttttgaagcaagctgcagaatcatatacacataggatctataaattatttgaagcagaatttctggatgggtgtggagcaacttcatgccatgaaacttcgagtggtggaaatttattgaggtttggaattacaatgcaggggaggggttcaaaagtatgggatgttgttcttgacacttccaccatggagatcagttgtggttgtagaaagtttgaaaggatgggtcttctttgttcgcatgccctcaaagtcttcaccctgcagaatgttgacacaattccagaaaagtatgttttgaaacgctggacaaaagatgccaggagaagcatgtatacacttgctcaggatgattcaacccaacaggaatgcacagaggctgaacttgcatatcgcaatcgggcaatgcagtatgcatataacctaattataaagagccaggaactggaagaatcacgaaaaatattctgggactcccttgaaactggagagaaggcactggaagtgttctttgaaatgagaaacatgcgcactcaagcagccaaggatgctgataagaatgtaaagaagaagaaaaaaacatcaaaaggaacaaacccaaaaaaagctaaacaagccccaggagtttcctcaactggtccagagctgatagtccatactaatgagcatcaatttcaatcttcacaagatgctcagggtaatgcaaccattggaagaccatattactatcaggcttttccaaatgcccctatacaaccaaaccagatgtacatgcatacaaatatgcacacaatgcccctttgcacaccgcaggagctgtctgcatatgctgcaatacgccccaattcaatgtttggtggtgccaagaacatctgaaggatattaaggtccagattcatgtggatgtcattggaaaaccttattgagactttcgctatcaactccgctttgatctctgtggacccatttatggaggcctggtggcacttcatgtttggttggttcaggggctcttcgttctgatctttagggaagcggttattctggctgttgcagtgcaggctgtgcagccccttatccatatagcagtggccagtggcttgctattaatatcactcacaggcaattttagggttgtaaactgtaaggtaggaggtagtgagagtaggtggtcattctacagatccagaatccagttgcatactatactgatatagggattgatttgcttgtgctaaaggcctcaatccgctgtgggcgtgagtttctccccttccaaggcagtttcctgcatgggttcagcttgagttgagctgctgagttgtgaacgaggaagcaaccaaagcaactgggagcctgggagagtgggagtggaggagctggctgccggcactggccgaggaactactcagtccaagacgtgtgtcgatctgaagtgacgctgacggctgacctatcacctatgttttggggtatggtttctcttctgatttatgttgcatacaagtttatataatgtaatatgtattttactcctggtcgacgagacgaagagacgattaatggacagattctaggaaattca

SEQ ID NO: 5128 - DNA, 3154 bp, Setaria italica
gatagcagtcaagattcccaagaagagaggcaccaaagaagggagaatggtgaagaaacagaaaaggcagctgattatgggagtgctttgagccgcaaggaggcaacagaagagctccttggttgcatagtccatagtgaggaagaggcatacagactgtactgcgactatgggcatcggatcggttttagtgtgcgaaagggcaagcagtcctactttatcggtaccaagaatattcgaacaaaggactactactgctcaaaggaagggcttaagtatgatgagcctgttacagaagcaaatttcaatcgaccagacacaagaactaattgcaaagcaatgatccgctttagggttgacgagaaggggcgatggacagtcatacgctttgttcctgtgcataatcaccaattggcgaaacctggggaaaggcacatgctgagatcagccaagtcgcttgcttttggcaaatcaggtgttatagatccatcagcatctacagagtcacatccaataaatggtttctcggatacaatcgaaggtgatacagctgataattcagggtatactataagggagtgttacaatcaagtgggcatgcagggtattacggttattgaggcaggcgacggccaaagtcttgtcagctatttcaagcgtagaaccaacgaggaaggcatgttttattgggatgtccaagttgatcaagaagggcgcatgaccaacttcttctatagggatggtaaatgtagaaatgattatggctgctttggagatgctattatatttgatacaacctaccgcactaataaatataacttgatatgtgccccatttgttggtgttgaccaccactggcagaatgttgtttttggctgtgcattcttgttagatgagtctgtagcttcctatgtctggttatttaaatcattcttggagtcaatgggagggaagtcaccaaaatcaatattcactgatcaggatgaagccattatgcaggcagttgagcaggttttccctaacacacaacattgcttttcctactggcatattctgaagaatgcacaatctcatttaggctcactaaatacatcacaagcatttcaacatttgtttatgcaaggatctgactcagaagaggattttgaggaatcatggactgcaatgctccgtgaatacaaactacaggataatagctggctgaatgaccttcataggttccgtcataaatggtgctcagcattgaacaaggatacatttgatggagggatcaattcttctcaatggggggaggtttcaaataatattctcagtggaatttctgatgaaaatacctctcttacacgttttgccctcttgctagaaaaggttgttaaggatctacggagaaatgaatctgaagaggattttcgctgtagccaaactgctccagttcgtgcagttaagcatagtacagttctgaagcaggctgcagaatcatatacacatcggatctacaaattatttgaggcagaatttctggatggatgcggagcaacttcatgtcatgaaacttcaagtggtggaaatctattgaggtttgaaattacgatgcaggggagaggttcaaaagtatgggctgttgctcttgacacttctaccatggaaatcacttgcggttgcagaaaatttgaaaggatgggtcttctttgttcacatgccctcaaagtcttcaccctgcagaatgtggacacaattccagaaaaatatgttttgaaacgatggacaaaagatgcccggagaagcatgtttaaacttgctcaagatgattcaacccaacaggaatgcacagaggctgaacttgcatatcgcaatcgggcaatgcagtacgcatataacctaattatgaagagccaggaattggaagaatcaagaaaaatattctgggactcccttgaaactggagagaaggcgcttgaagtgttctttgaaatgagaaacatgcgcactcaagctgccaaagatgctagtaatagagagaaaaagaagaaaaaaccatcaaaaggaccaaactcaaaaaaagcaaaacaagccccagcagcttcctcagctggtctggagctgattgtccaaactaatgagcatcaatatcaaccttcacaagatgctcagggtaatgcaacgattggaaggccatattattatcaggcttttccaactgcccctatccaaccaaatcagatgtatatgcatccgaatgtgcacacaatgcccctgtgcacatcacagcaggatcatctgcctgcatatgctgcaatacgccccaattcaaattttggtggtgccaagaacatctgaaggataataagggcaatagctggttacatttaaacaatgttcctatgcctgctctgcacatgataccaacccatactgtagtgagctcggggattacatgctgaagtcttgctactcttaatttccaagttcctctggatgttgctggaaaatcttgtttgaggatttcagctaccaactcaggcttgaactctgtcgaccctttgtgtaggcctggcggtgcttcttcacattggtcagttcattggccctttctgccggtcttgagggaagtggctcttctggctgttgctgtgcaacctcttgtgcatagagcagcagcagctcaatattagtctgaggcaggcaattttaggcttgtaaattgtaagtcgtgagattggttgagagttaggtcatattacatctctgcagaatcagaatccagttgcagactatgttgatgtagggacggcttctcttgtgcaagaaactgtctcagctcaaacaacacaagcctgccagtggcagtggcaccaggcacctgctctgctcaccacctgggctcctggcgacggagatcgccattcctgcatgagttgagcttgtcctgagcagccgaatcgctgcgcgtcaaagcaagcggcggcaggatgggtagtgtgctccccggcccagcatggattcggatgctgacctctgtttttttggatatttaattttttgccatctggatggcaactcttcgatcgccagttttacatttgccacatggaagagatccatgccaattttgcttacctggcacaatacatgggctcgtcagcattgaaatgac

SEQ ID NO: 5129 - DNA, 2921 bp, Setaria italica
tagaaatggatagcagtcaagattcccaagaagagaggcaccaaagaagggagaatggtgaagaaacagaaaaggcagctgattatgggagtgctttgagccgcaaggaggcaacagaagagctccttggttgcatagtccatagtgaggaagaggcatacagactgtactgcgactatgggcatcggatcggttttagtgtgcgaaagggcaagcagtcctactttatcggtaccaagaatattcgaacaaaggactactactgctcaaaggaagggcttaagtatgatgagcctgttacagaagcaaatttcaatcgaccagacacaagaactaattgcaaagcaatgatccgctttagggttgacgagaaggggcgatggacagtcatacgctttgttcctgtgcataatcaccaattggcgaaacctggggaaaggcacatgctgagatcagccaagtcgcttgcttttggcaaatcaggtgttatagatccatcagcatctacagagtcacatccaataaatggtttctcggatacaatcgaaggtgatacagctgataattcagggtatactataagggagtgttacaatcaagtgggcatgcagggtattacggttattgaggcaggcgacggccaaagtcttgtcagctatttcaagcgtagaaccaacgaggaaggcatgttttattgggatgtccaagttgatcaagaagggcgcatgaccaacttcttctatagggatggtaaatgtagaaatgattatggctgctttggagatgctattatatttgatacaacctaccgcactaataaatataacttgatatgtgccccatttgttggtgttgaccaccactggcagaatgttgtttttggctgtgcattcttgttagatgagtctgtagcttcctatgtctggttatttaaatcattcttggagtcaatgggagggaagtcaccaaaatcaatattcactgatcaggatgaagccattatgcaggcagttgagcaggtttccctaacacacacattgcttttcctactggcatattctgaagaatgcacaatctcatttagctcactaaatacatcacaagcatttcaacatttgtttatgcaaggatctgactcagaagaggattttgaggaatcatggactgcaatgctccgtgaatacaaactacaggataatagctggctgaatgaccttcataggttccgtcataaatggtgctcagcattgaacaaggatacatttgatggagggatcaattcttctcaatggggggaggtttcaaataatattctcagtggaatttctgatgaaaatacctctcttacacgttttgccctcttgctagaaaaggttgttaaggatctacggagaaatgaatctgaagaggattttcgctgtagccaaactgctccagttcgtgcagttaagcatagtacagttctgaagcaggctgcagaatcatatacacatcggatctacaaattatttgaggcagaatttctggatggatgcggagcaacttcatgtcatgaaacttcaagtggtggaaatctattgaggtttgaaattacgatgcaggggagaggttcaaaagtatgggctgttgctcttgacacttctaccatggaaatcacttgcggttgcagaaaatttgaaaggatgggtcttctttgttcacatgccctcaaagtcttcaccctgcagaatgtggacacaattccagaaaaatatgttttgaaacgatggacaaaagatgcccggagaagcatgtttaaacttgctcaagatgattcaacccaacaggaatgcacagaggctgaacttgcatatcgcaatcgggcaatgcagtacgcatataacctaattatgaagagccaggaattggaagaatcaagaaaaatattctgggactcccttgaaactggagagaaggcgcttgaagtgttctttgaaatgagaaacatgcgcactcaagctgccaaagatgctagtaatagagagaaaaagaagaaaaaaccatcaaaaggaccaaactcaaaaaaagcaaaacaagccccagcagcttcctcagctggtctggagctgattgtccaaactaatgagcatcaatatcaaccttcacaagatgctcagggtaatgcaacgattggaaggccatattattatcaggcttttccaactgcccctatccaaccaaatcagatgtatatgcatccgaatgtgcacacaatgcccctgtgcacatcacaggatcatctgcctgcatatgctgcaatacgccccaattcaaattttggtggtgccaagaacatctgaaggataataaggcctggcggtgcttcttcacattggtcagttcattggccctttctgccggtcttgagggaagtggctcttctggctgttgctgtgcaacctcttgtgcatagagcagcagcagctcaatattagtctgaggcaggcaattttaggcttgtaaattgtaagtcgtgagattggttgagagttaggtcatattacatctctgcagaatcagaatccagttgcagactatgttgatgtagggacggcttctcttgtgcaagaaactgtctcagctcaaacaacacaagcctgccagtggcagtggcaccaggcacctgctctgctcaccacctgggctcctggcgacggagatcgccattcctgcatgagttgagcttgtcctgagcagccgaatcgctgcgcgtcaaagcaagcggcggcaggatgggtagtgtgctccccggcccagcatggattcggatgctgacctctgtttttttggatatttaattttttgccatctggatggcaactcttcgatcgccagttttacatttgccacatggaagagatccatgccaattttgcttacct

SEQ ID NO: 5130 - DNA, 2850 bp, Brachypodium distachyon
aaatggatagcagtcaagattctccaatgagcaagaatggcgaagaagcgaaaaaaggggaagattacggaaatggtttgagccgcaaggaggcagccgaggagtttattggttgcgtggtccatagtgaggaagaggcatacaggctgtattgtgactatggacatcgaattggcttcagcgtccgaaagggcaaacagtcctacgtcattggtaccaggattattcgaacgaaagattactactgctcaaaggaagggcttaaatatgatgagcctgttacagaagcaaatttcaaccggccagacacaagaactaattgcaaagctatggttcgctttagagttgatgataaaggacgttggacggtcatacgctttattcctgttcataatcaccagctggctaaacctggggaaaggcacatgttgaggtcggcaaagtcgtttgctgttggaaaatcaggtgttatagatccagcatctgctgaatcacatccaatgaatggtctctctgataggaccgtagatgatactgttgagcctccaggatacactataagggattgctacaatcatgagaacgtgcagggtataacactaattggggcaggagattgccaaagtcttgtaagctatttcaagcgcagaaccaatgaggaaggtatgttttattgggacgtccaagttgatcaagaaggtcgcatgactaactttttcttcagggatggcaaaagtaaaaatgattatgactgctttggagatgctgttatatttgacaccacgtaccgcacaaataaatatagcctgatctgtgccccttttgttggagttaatcaccattggcacaacattgtttttggttgtgcgttcctgttagatgactccacagcttcctatgtttggctatttaaatcatttttggaatcaatgggtggccgatctccaaaatccatttttactgatcaggatgaggctatcatgcaagcagctgagcaggtgtttcctaacacacaacattgcttctcctactggcatattctgaagaatgcacagtctcatttaggcacagttaatacttctcaagactttcaaaatatgtttatgaagtgcatgcaaggatctgacacaaaaatggagcttgaggaatcgtgggctgctatgctacatgaatacaaactacaggataatgattggcttaatgatctctataggtttcataacagatggtgctcagcatttaacaaagatacttttgatggtgggatcaattcatctcagtggggagaggtctcaaacaatatcctcactggaattgctgatgaatctacttctctaacaagatttgccctcttgctggaaaaggctgtgaaatctctacgtagaaatgaatcggaagaggattttcgctgcagccaaactgctcctgttcgtgcaatcaagcatagtacagttctgaagcaggctgcagaatcatatacacataggatctacaaattatttgaggcagaatttctagatggatgtggagcaacttcatgccatgaaaattcctgtggtggaaacttgttgcggtttgaaataacgatgcaggggcggggttcaaaagtgtggactgttcttcttgacacatctacaatggaaatctcttgtgggtgcagaaaatttgaaaggatgggtcttctttgttctcatgctctgaaagccttcagcctgcagaatgtggataccattcctgaaaagtacattttgaaacgctggacaaaagatgccaggagaagcatgtacaagctcagtcaagaagattcaacacaacaggaatgtaccgaggctgaacttgcgtatcgcaatcgggcaatgcagtatgcatatagccttataatgaagagccaggaactggaagaatctagaaagatattctgggactcccttgaaacaggtgagaaggcactggaagtgttcttcgaaataagaagtctgcatgctcaacctgcaaaagatgccagtaaaacggggaagaagaaatcgtctaaaggaccaagcaacaagaaagcaaggcaagccctgccatcctcctcgcctgttcctggaatacttgcccaagctaacgagcaccagtttcaagcagcacaagatgcacatggtaattcaacaattggaagaccattttactttcaggctttttcatctacaccttgccaaccaaaccagatctatatacatccgaacacaatgcctgtttgtgcaccacaggatttgtcagcatatcctgcaattcgtcccagttaaaattaaggtggcgcaaggaacatctaaaggacactaaggttacaaatcctgctctacccaagagactctacccatattgcactctgagacttccagggtctgctagatgtacttttaccaaactttcattggagactactggtaccagccgccaatgtatctttgtgaaccattaaaaaggcaacatggtgcttgcctgcatggcatgttggctgagatgctgctcttgagtcttgagagaagtagctatctctatcctgggagtctgacgattaattataccccgttgacttgtaattttttcagcgtagcttgttggtcgtctcacactagtaggcaatttaagaatgtaagctgtaactacgatagtagccattagctattagcaggaatcctgagattgagctcattgactcggttcaaacttgccttgatttctggtgctgcaaccatattgtatctagtttttggagtacatgtgtacgtaatcttaaccatgattgatatggcaactcagggcgatcatatctgatggagggcgaatagatattgtgatttaacc

SEQ ID NO: 5131 - DNA, 2860 bp, Brachypodium distachyon
gttgagcagaaatggatagcagtcaagattctccaatgagcaagaatggcgaagaagcgaaaaaaggggaagattacggaaatggtttgagccgcaaggaggcagccgaggagtttattggttgcgtggtccatagtgaggaagaggcatacaggctgtattgtgactatggacatcgaattggcttcagcgtccgaaagggcaaacagtcctacgtcattggtaccaggattattcgaacgaaagattactactgctcaaaggaagggcttaaatatgatgagcctgttacagaagcaaatttcaaccggccagacacaagaactaattgcaaagctatggttcgctttagagttgatgataaaggacgttggacggtcatacgctttattcctgttcataatcaccagctggctaaacctggggaaaggcacatgttgaggtcggcaaagtcgtttgctgttggaaaatcaggtgttatagatccagcatctgctgaatcacatccaatgaatggtctctctgataggaccgtagatgatactgttgagcctccaggatacactataagggattgctacaatcatgagaacgtgcagggtataacactaattggggcaggagattgccaaagtcttgtaagctatttcaagcgcagaaccaatgaggaaggtatgttttattgggacgtccaagttgatcaagaaggtcgcatgactaactttttcttcagggatggcaaaagtaaaaatgattatgactgctttggagatgctgttatatttgacaccacgtaccgcacaaataaatatagcctgatctgtgccccttttgttggagttaatcaccattggcacaacattgtttttggttgtgcgttcctgttagatgactccacagcttcctatgtttggctatttaaatcatttttggaatcaatgggtggccgatctccaaaatccatttttactgatcaggatgaggctatcatgcaagcagctgagcaggtgtttcctaacacacaacattgcttctcctactggcatattctgaagaatgcacagtctcatttaggcacagttaatacttctcaagactttcaaaatatgtttatgaagtgcatgcaaggatctgacacaaaaatggagcttgaggaatcgtgggctgctatgctacatgaatacaaactacaggataatgattggcttaatgatctctataggtttcataacagatggtgctcagcatttaacaaagatacttttgatggtgggatcaattcatctcagtggggagaggtctcaaacaatatcctcactggaattgctgatgaatctacttctctaacaagatttgccctcttgctggaaaaggctgtgaaatctctacgtagaaatgaatcggaagaggattttcgctgcagccaaactgctcctgttcgtgcaatcaagcatagtacagttctgaagcaggctgcagaatcatatacacataggatctacaaattatttgaggcagaatttctagatggatgtggagcaacttcatgccatgaaaattcctgtggtggaaacttgttgcggtttgaaataacgatgcaggggcggggttcaaaagtgtggactgttcttcttgacacatctacaatggaaatctcttgtgggtgcagaaaatttgaaaggatgggtcttctttgttctcatgctctgaaagccttcagcctgcagaatgtggataccattcctgaaaagtacattttgaaacgctggacaaaagatgccaggagaagcatgtacaagctcagtcaagaagattcaacacaacaggaatgtaccgaggctgaacttgcgtatcgcaatcgggcaatgcagtatgcatatagccttataatgaagagccaggaactggaagaatctagaaagatattctgggactcccttgaaacaggtgagaaggcactggaagtgttcttcgaaataagaagtctgcatgctcaacctgcaaaagatgccagtaaaacggggaagaagaaatcgtctaaaggaccaagcaacaagaaagcaaggcaagccctgccatcctcctcgcctgttcctggaatacttgcccaagctaacgagcaccagtttcaagcagcacaagatgcacatggtaattcaacaattggaagaccattttactttcaggctttttcatctacaccttgccaaccaaaccagatctatatacatccgaacacaatgcctgtttgtgcaccacaggatttgtcagcatatcctgcaattcgtcccagttaaaattaaggtggcgcaaggaacatctaaaggacactaaggttacaaatcctgctctacccaagagactctacccatattgcactctgagacttccagggtctgctagatgtacttttaccaaactttcattggagactactggtaccagccgccaatgtatctttgtgaaccattaaaaaggcaacatggtgcttgcctgcatggcatgttggctgagatgctgctcttgagtcttgagagaagtagctatctctatcctgggagtctgacgattaattataccccgttgacttgtaattttttcagcgtagcttgttggtcgtctcacactagtaggcaatttaagaatgtaagctgtaactacgatagtagccattagctattagcaggaatcctgagattgagctcattgactcggttcaaacttgccttgatttctggtgctgcaaccatattgtatctagtttttggagtacatgtgtacgtaatcttaaccatgattgatatggcaactcagggcgatcatatctgatggagggcgaatagatattgtgatttaacca

SEQ ID NO: 5132 - DNA, 1472 bp, Oryza sativa
aagaaaaccaaaaccacttctcgtttcctcgatcaccatacgcgtacaaatacaaattcaggtagagtagtatactgtacgtctacacctctctgcatagagtactcttttccttgccttagaaaaaggggaaaatctatctgcgaggctgcaaacgcccccctggccagcagcctctctctgtgtatataaatgccctaccacacctccctgatccccaaatgtctctccggcccctctgaatccatccttaaagactaaaccctccataagcctcctctctctctttcttccaggagacaggtgacaagggggatagatacacaacgatactccgcagcgcaggaggaggacacatccttgatttctgccatcggaggagctcctgcctcggagatacacgaagctgctacatcttcttccagctcaatcgtatcgacgcttgcatctcttttgctcagagtgatcgtcgtttttcacagcttgcaggaaaaaaagggcaagaaagactgagagcagcagaagaggaagatgatgatgaccgaggtcgccaatcacagcaaaaggaaccacaatgaaagctacttcaccgggaaagcagcagtcaccagcagctcggaggagtttgggagcatgacatccaagaagccgaggaacacaagcccgagagacgctcccgtctccccgaaggagaagaaggataagattggtgagagagtggctgcactgcagcagctagtgtcaccatttgggaagacggacactgcttctgttcttcaggaggcctcagggtacatcaagtttcttcaccagcagctcgaggttcttagctccccttacatgcgtgctcctccggtgcctggcgctgcgcctgaggatcccgaccactacagcctgaggaaccgtggcctctgcctggttccagtggaccagacgctgcagctgacgcagagcaacggcgccgacctgtgggcgccggcgaacacgaccaggcgcaggtgaacggaggaaccggcctggaggctcgggggtctaagaggcctagaggaggaggggagcacttttgtctgggggcggtgtagagttccaacttccaagtgtctgacccgattcatcaaatctcctaacaaagcaaaaactaataagcaaaccgtgtttcactctcgtcggatctcttgcctgtaatatagtagtagctgcaaccctgcctgcaggtcggtgtgagaccgtgagagtgtgctactgatgagtctgtgttagcgccggacatatgtgtgtaatcatcatacatagcgaggtgatagtactagactacctgatgtgcccatatgtgatatgtaactatgtgtctcttcagtaacatgatagtagcagcatgttgctgctagcaaccaagttcaatgtgattgagtacatcagccctgctgtagtttttgtaagaagtgctcagtttctgctagaagcaaaaaaaa

SEQ ID NO: 5133 - DNA, 1380 bp, Oryza sativa
ctctgcatagagtactcttttccttgtcttagaaaaatgggaaatctatctgcgatgctgaaacgcccccctgtccatcagcctctctctgtgtatataaatgccctaccatacctccctgatccccaaatgtctctccggcccctctgaatccatccttaaagactaaaccctccataagcctcctctctctctttcttccaggagacaggtgacaagggggatagatacacaacgatactccgcagcgcaggaggaggacacatccttgatttctgccatcggaggagctcctgcctcggagatacacgaagctgctacatcttcttccagctcaatcgtatcgacgcttgcatctcttttgctcagagtgatcgtcgtttttcacagcttgcaggaaaaaaagggcaagaaagactgagagcagcagaagaggaagatgatgatgaccgaggtcgccaatcacagcaaaaggaaccacaatgaaagctacttcaccgggaaagcagcagtcaccagcagctcggaggagtttgggagcatgacatccaagaagccgaggaacacaagcccgagagacgctcccgtctccccgaaggagaagaaggataagattggtgagagagtggctgcactgcagcagctagtgtcaccatttgggaagacggacactgcttctgttcttcaggaggcctcagggtacatcaagtttcttcaccagcagctcgaggttcttagctccccttacatgcgtgctcctccggtgcctggcgctgcgcctgaggatcccgaccactacagcctgaggaaccgtggcctctgcctggttccagtggaccagacgctgcagctgacgcagagcaacggcgccgacctgtgggcgccggcgaacacgaccaggcgcaggtgaacggaggaaccggcctggaggctcgggggtctaagaggcctagaggaggaggggagcacttttgtctgggggcggtgtagagttccaacttccaagtgtctgacccgattcatcaaatctcctaacaaagcaaaaactaataagcaaaccgtgtttcactctcgtcggatctcttgcctgtaatatagtagtagctgcaaccctgcctgcaggtcggtgtgagaccgtgagagtgtgctactgatgagtctgtgttagcgccggacatatgtgtgtaatcatcatacatagcgaggtgatagtactagactacctgatgtgcccatatgtgatatgtaactatgtgtctcttcagtaacatgatagtagcagcatgttgctgctagcaaccaagttcaatgtgattgagtacatcagccctgctgtagtttttgtaagaagtgctcagtttctgctagaagcaagaaaaa

SEQ ID NO: 5134 - DNA, 1056 bp, Leymus cinereus x Leymus triticoides
  misc_feature (9)..(10): n is a, c, g, or t
aaaaaaganngattcttgatggttgatgctcatgatacccttgaccgtctcttgtcatgccgtttccattattgttacttgcgtagcagttgagtaggagctcatataaaactgaaactaggtttgtttgtcgactgaaaccagctaggggagggtgatttccatgaaaccgacctctgaaccaacgactacagttgtaaaagtcagcttttactccagaccggaggctagctcgtagtcatacagaaacactcctggttttcagcaggaaaaaaagggcgaacgcatagccagcagcagtagcggaagaggaagatgatgatgactcaagtggccaaccacagcaagaggaaccacaccgacagctacttcagcgggaagcagcaggccgtcgccaccagcagcggctcggaggagttcgggggcatggggtccaagaagccgaggaacgcgagccccaggggcgccggccccatttctcccaaggagaagaaagacaaggtcggcgagagagtggcggcactgcagcagctcgtgtcgccatttgggaagacggacacggcttctgttcttcaggaggcgtcgggctacatcaagttcttgcaccagcagctcgaggttcttagctccccctacatgcgccctcctccggcgcccggcgctgagcctgaggatccggaccactacagcctgcggaaccgcggcctctgcctggtgccggtggagcagacgctgcagctgacccagagcaacggggcggacctctgggcgccggcgaacaccaccagacgctgctgaagcgaagcccgagggtggtctcggcggcgatggccgcattgcgtggcgggggtagaattccggtgcaggcgcgtggctgacccaattcggtctcctagctaacacaatcgtttcgtttctgtgaacctcaacagaccctgtgttggcgccggtagtgtgtatgtgtaatcgtggtcgttgcgtgagtgactatgtggtttaacatggtagcgacctgtcgctgccgccgactaatcatcaaaagcagcagtttcatgc

SEQ ID NO: 5135 - DNA, 1082 bp, Brachypodium distachyon
ggcccctcctcctcccctcctgcatccttaaaccccccataagccttcttctcctttctccctctctctccgggagacaggaaaaacgcagtcagtataaacagcgccgtgcatctgccattgctggagtcgatcgatcaaggtcccggacgcagattcatagctccagcatcgtggtctccccttgctcaaagtgccgccccagggaaaaagggatagcagaacaaggaaggagatgatgatgatgacagaagtggccaatcacagcaaaagggatcacaccgacagctacttcagtgggaaggccggcatggccaccagcggcagcggcagcggctcggaggagttcggcagcatggggtcaaagaagccgaggaacagcagcccgaggagcggcgctcccatatcccccaaggagaagaaggacaaggttggcgagagagtggcggcgctccagcagctggtgtcaccatatgggaagacggacacggcttccgttcttcaggaggcctccggctacatcaagttcttgcacaagcagctggagactcttagctccccgtacatgcgcgctcctccggcgcccggtgctgcgcctgaggatcccgagcactacagcctgcggaaccgcgggttgtgcctggtgccggtggaccagacgctgcagctgacgcaagacaacggggccgacctctgggcgccggccaacaccgccaggcgcaggtgaagaagcgaagccaagctcaagtccgtccggcacagatcgatcgaccaaagagccggcggtggccggattttggtcgccttattagagttccaccaggcgcgcgtggctgaccacccaattcaatctccctaacacaaaatcgttttctctgaacctgaacccgctctgctgcctttggcgcctgcagtatgtctttctttctgtctgtaatcgtatatagcgagacgacgcggtgctgctcgatctccgtgggatgtgtctgtaactatgtgggttattaacatagtagcgacctgctgctgacctgctgtcgacggctaaacaaaaccagcagtttcagaccttgaagagtgcc

SEQ ID NO: 5136 - DNA, 1838 bp, Brachypodium distachyon
gcggaaaggggcacgcacgcaggaaagcgaaacaaacaaaccagaggcacgatttctagcgccagttccacatcaccttcctctctatccatccctctgctctgctgggggtacctttccttttgttattttgtttgcttggtgtatttttgggatgtgcagctagcgatttcacgcgaagaggaaattcccattcccttttcattctttcttcttcttcttcttcttcgcatcgtcgctctcggacagataggaggagcgtgccgtgccgctgctataaagtattcccttccttgtcttagaaaaagagagatctatctgcaacgcgcggtgccgctagacaccaccggctctgtgcctctgtgagcaatatataaatgctcagagggcctccctgatccccaaatgtccctccttggcccctcctcctcccctcctgcatccttaaaccccccataagccttcttctcctttctccctctctctccgggagacaggaaaaacgcagtcagtataaacagcgccgtgcatctgccattgctggagtcgatcgatcaaggtcccggacgcagattcatagctccagcatcgtggtctccccttgctcaaagtgccgccccagggaaaaagggatagcagaacaaggaaggagatgatgatgatgacagaagtggccaatcacagcaaaagggatcacaccgacagctacttcagtgggaaggccggcatggccaccagcggcagcggcagcggctcggaggagttcggcagcatggggtcaaagaagccgaggaacagcagcccgaggagcggcgctcccatatcccccaaggagaagaaggacaaggttggcgagagagtggcggcgctccagcagctggtgtcaccatatgggaagacggacacggcttccgttcttcaggaggcctccggctacatcaagttcttgcacaagcagctggagactcttagctccccgtacatgcgcgctcctccggcgcccggtgctgcgcctgaggatcccgagcactacagcctgcggaaccgcgggttgtgcctggtgccggtggaccagacgctgcagctgacgcaagacaacggggccgacctctgggcgccggccaacaccgccaggcgcaggtgaagaagcgaagccaagctcaagtccgtccggcacagatcgatcgaccaaagagccggcggtggccggattttggtcgccttattagagttccaccaggcgcgcgtggctgaccacccaattcaatctccctaacacaaaatcgttttctctgaacctgaacccgctctgctgcctttggcgcctgcagtatgtctttctttctgtctgtaatcgtatatagcgagacgacgcggtgctgctcgatctccgtgggatgtgtctgtaactatgtgggttattaacatagtagcgacctgctgctgacctgctgtcgacggctaaacaaaaccagcagtttcagaccttgaagagtgccaatatgcagtgcagtgcatttgtgtgtgctcctctgcgtttccgtcggtgcaatcttcaggtacgctaaaagagactgaacttgcagcaaatcgcacagcatgcaggtagcctagatgctttttgaggggcgagaggtttccaaatcgtgccgaaagccgatcgacctgtcaggttcaaaccaccggatatcggtctctgacaatgatttaatctaatcttctaatatctaatctaactaaagtggcagaaattctacggtctagattttgcaaaagttatggcaccagaacgcatgcaaacctgatcgctatggaaaccatcccagaatgtatcctaa

SEQ ID NO: 5137 - DNA, 1034 bp, Avena sativa
ggatccccaaatgtccccgccccctcatacatccttaaacctcccataagccttcgtctccttccttctctttctctctctgctcccgtcctcctcctccgtctccggctccgggaggccgaggcaggagccactggagtgcctcgacccggccggagaaagatagcgcggctgcccgtcctcgatctctccggctcaagatttccccgcaggaaaagaagggcgaggggattgtgagcagtggtagtagtaggaggaggagaagaggaagatgatgatgaccgaagtggccaaccacagcaaaaggaaccacaccgacagctacttcagtgggaagcaggccgtcgccaccagcagcggctcggaggagttcgtcgtgggcatggggtcgaagaagccgaggaacgccagccccaggggcggtggcggcggcggtcccatatcgccaaaggagaagaaggacaaggtcggcgagagagtggcggcgctgcagcagctggtgtcgccgtacgggaagacggacacggcctctgttcttcaggaggcatcggggtacatcaagttcctgcaccagcagctcgaggtcctcagcaccccctacatgcgcgctcctccggcgcccggcgctgagcctgaggatcctgaccactacagcctgcgcaaccgcggactgtgcctggtgccggtggagcagacgctgcagctgacccagagcaacggtgccgacctctgggctccggctcacaccaccaagcgcaggtgaaggaagccaagcgaagcccgcgcgcatctttgtggaccgacaccaatcgccggccgcaccaattcaatctcctcctaacataaatcgtttctctgaacctgatcgtacccttgtcctggcgcccgatagtatgtgtaatcgtatatagcgagacgacgcaccaccgatcgatcgatcgaccgaccgacatctgtgtgtgcaactatgtggtttaacatggtagcgacctgttgctgtcgccgactaatcaaaaccagcagttccatgccaa

SEQ ID NO: 5138 - DNA, 1022 bp, Avena sativa
gtccccgccccctcatacatccttaaacctcccataagccttcgtctccttccttctctttctctctctgctcccgtcctcctcctccgtctccggctccgggaggccgaggcaggagccactggagtgcctcgacccggccggagaaagatagcgcggctgcccgtcctcgatctctccggctcaagatttccccgcaggaaaagaagggcgaggggattgtgagcagtggtagtagtaggaggaggagaagaggaagatgatgatgaccgaagtggccaaccacagcaaaaggaaccacaccgacagctacttcagtgggaagcaggccgtcgccaccagcagcggctcggaggagttcgtcgtgggcatggggtcgaagaagccgaggaacgccagccccaggggcggtggcggcggcggtcccatatcgccaaaggagaagaaggacaaggtcggcgagagagtggcggcgctgcagcagctggtgtcgccgtacgggaagacggacacggcctctgttcttcaggaggcatcggggtacatcaagttcctgcaccagcagctcgaggtcctcagcaccccctacatgcgcgctcctcctgcgcccggcgctgagcctgaggatcctgaccactacagcctgcgcaaccgcggactgtgcctggtgccggtggagcagacgctgcagctgacccagagcaacggtgccgacctctgggctccggctcacaccaccaagcgcaggtgaaggaagccaagcgaagcccgcgcgcatctttgtggaccgacaccaatcgccggccgcaccaattcaatctcctcctaacataaatcgtttctctgaacctgatcgtacccttgtcctggcgcccgatagtatgtgtaatcgtatatagcgagacgacgcaccaccgatcgatcgatcgaccgaccgacatctgtgtgtgcaactatgtggtttaacatggtagcgacctgttgctgtcgccgactaatcaaaaccagcagttccatgccaa

SEQ ID NO: 5139 - DNA, 1813 bp, Zea mays
gcacgaccaaaggcaagtgggcggcagactgccttcactctcactcccgcccgtgtccctcgccctgtccgcgctgcggtgcgccctccctgcgccgctgttaatggaaacggcgcggcgtttccttcccaccacctcctcctcctcctcctgcacggcctcttcttcgctacgattcgccgcttctccgctcttcttctccttcccctgcagataaagcggctggttgccctggaagccttgcggtggagacggtctcggtctcggatccaggggagacacgcggatttgctgccatggtgaggtggggcgagatggtggaggaggaagaggacgacgagtacgctaagctggtcaggaggatgaatccaccgagagtggtcatcgacaacgactcgtgtggcaacgcaactgtcatccgggttgatagggtcaataagcatggcattttactggaagcagttcaggtccttgtcgatctcaacctcgtcatcaccaaggcttacatttcttcagacggcaactggttcatgcatgtgttcaatgtgaccgatcaggacgggagtaagcttcataacagggaggtcattgaccatattcagaaatgcctggaatcagacggctaccttgttcctccggcgaacggttatgcgctgccggaagaccagttcacctccattgagctgacgggcgcggaccgcccgggcctcctctcagaggtgtgcgccgtgctcgccaccctgagctgcaacatcgtgaaggccgaggtgtggacgcacgacgggcgcaccgccgccgtgatccaggtcaccgacgaggccaccgggcgcgccgtccacgacgcgggccggctgtccagggtgcaggagcttctccgcgacgtgatgcggggcgacggcacgtgcaaccgcggcggcacgggaatttccgcggagaggcgcctgcatacgctgatgctggacagcgtcggcggcggcggtgccgaggaggctggtggcggccgtgacgagagcggtggatgtggcgtggcgaggcccaaggtcgtggtgatggactgcgcggagaggcggtacacggtggtgatcctgcggtgcagggaccggccgaagctgctgttcgacacgctgtgcgcgctcgccgacctgcagtacgtcgtgttccacggcacggtcgacgccgagggagccagcaaggacaaggaggcctaccaagagtactacatccggcacgtcgacggccacccggtgcgctccgacgccgagcgggcccgcctcgtccggtgcctagaggccgccgtcgagaggcgcgcgtccaacgggctggagctagaggtgtggacggaggacagggtggggctgctgtcggagatcacgcgcgtgttccgggagaacagcctctccatcatccgggcggcgatcacgaccagggacggcaaggccgaggacacgttctacgtgtcggacgcgtacggcaaccccgtcgacggcaggaccatggacgcggtgggggagcagctcgggcacgccgtgctgagggtgaagcgcggcggccacgacgcgcccgtcaagcacgaggccgagggcggcgcggtgtccgtccttggcagcctgctcaagagctcgttccagggcctgagactcatcagatcctactcgtaaaccgtaatcgaagaacataataaagccctgggccttgtacatatataaaatctcacgtaggttaggaaatagtgaagcagcattgtaaatatcatatcagtcgcatggtaaatatcataccgttacaagtgcataaatctcattacattacagca

SEQ ID NO: 5140 - DNA, 1910 bp, Setaria italica
ccgcggctcgtggaggacgacgacgaccagcaggccggtcactcccccaaggcaacttggcggcagactgcctttactcccgcgccgtgtccctcgcgctctgtcctctcctctcctcggccgccggcctccccccgcgccgctgtcccctcctcctctcgcgaggtctcttcttccctacgactcgaagtcctcggctattcgccttcacctgcagataaagcgggtggttggcttggaagcctcgcggtggtcagggtatcgactctatcaagggaggcgcgcggcgtgttctgctctgcggccatggttaggtgcgtggagatggtggcggaggaggaggacgacgacgagtacgccaagttggtccggaggatgaacccaccgagagttgtgatagacaatgactcgtgcaacaacgcaaccgtcatccgggttgatagggtcaagaagcatggcattttactggaggcagtccaagtccttgtcgatctcaacctcgtcatcacgaaggcgtatatttcttcggatggcaactggttcatggatgtgttcaatgtgactgatcaggacgggagtaagcttcagaatagggaggtcattgaacatattcagaaatgcctagaatcagaagactaccttgcgttgccggcaatcgggctaaaggatggagctgcgccgtcagaggatcagtccacctctatcgagctgaccggcactgaccggccgggcctgctgtcggaggtgtgcgccgtgctggcctccctgagctgcaacatcgtgaaggccgaggtgtggacgcacgagaggcgcgccgccgcggtgatccagatcaccgacgaggccaccgggctcgccatccgcgacgcgggccggctgtccaaggtgcaggagcttctccgcaacgtgatgcagggcgacggcaccgcccggagaggaggcggcagcacgtgcacaggcggcgtgtccgtgggcgcggcgcgcgcggagaggcgcctgcataagctgatgctcgacgacggtgccggtggtagtgccggcgaggaggctgtcgacggcgaggaccggtgcggcaaggcgaggcccaaggtcgccgtgatggactgcacggagaggcagtacacggtggtgatcctgcagtgccgggaccggccgaagctgctgttcgacacgctgtgcgcgctcaccgacctgcagtacgtcgtgttccacggcaccgtcgacgccgagagagggagcaaggaggcctaccaagagtactacatacggcacgtcgacgggtacccggtgcgctccgacgccgagcggacccgcctcgtccggtgcctcgaggccgccgtcgagcggcgagcttccgacggattggagctggaggtgaggacggaggacagggtgggcctgctgtcggagatcacgcgcgtgttccgggagaatagcctgtccatcatccgcgcggcgatcgcgaccagggacggcagggcggaggacacgttctacgtgtcggacgcgtacggcaaccccgtcgacggccggaccgtggacgcggtgggcgagcagctcgggcacgccgtgctgcgggtgaagcgcggcggcggtggccgcggcccgcccgtggccgagggcggcgcggtgtccgtcctgggcagcctgctgaagggctcgttccagggtctcaggctgatcaggtcctattcataatccaaggattctgattagttacacgaccgggcagtgctttgtggtttgtacatacaaatctgacgtaggttagggaataatgaagcagaagggcgtggatgctgcattgtacatttgcacaggaagtcacatgtcattaccagcattattgtgaattagcaatacaattacaggttagcagaaatttagccatttcatgaggccatttaacg

SEQ ID NO: 5141 - DNA, 1812 bp, Setaria italica
tacgactcgaagtcctcggctattcgccttcacctgcagataaagcgggtggttggcttggaagcctcgcggtggtcagggtatcgactctatcaagggaggcgcgcggcgtgttctgctctgcggccatggttaggtgcgtggagatggtggcggaggaggaggacgacgacgagtacgccaagttggtccggaggatgaacccaccgagagttgtgatagacaatgactcgtgcaacaacgcaaccgtcatccgggttgatagggtcaagaagcatggcattttactggaggcagtccaagtccttgtcgatctcaacctcgtcatcacgaaggcgtatatttcttcggatggcaactggttcatggatgtgttcaatgtgactgatcaggacgggagtaagcttcagaatagggaggtcattgaacatattcagaaatgcctagaatcagaagactaccttgcgttgccggcaatcgggctaaaggatggagctgcgccgtcagaggatcagtccacctctatcgagctgaccggcactgaccggccgggcctgctgtcggaggtgtgcgccgtgctggcctccctgagctgcaacatcgtgaaggccgaggtgtggacgcacgagaggcgcgccgccgcggtgatccagatcaccgacgaggccaccgggctcgccatccgcgacgcgggccggctgtccaaggtgcaggagcttctccgcaacgtgatgcagggcgacggcaccgcccggagaggaggcggcagcacgtgcacaggcggcgtgtccgtgggcgcggcgcgcgcggagaggcgcctgcataagctgatgctcgacgacggtgccggtggtagtgccggcgaggaggctgtcgacggcgaggaccggtgcggcaaggcgaggcccaaggtcgccgtgatggactgcacggagaggcagtacacggtggtgatcctgcagtgccgggaccggccgaagctgctgttcgacacgctgtgcgcgctcaccgacctgcagtacgtcgtgttccacggcaccgtcgacgccgagagagggagcaaggaggcctaccaagagtactacatacggcacgtcgacgggtacccggtgcgctccgacgccgagcggacccgcctcgtccggtgcctcgaggccgccgtcgagcggcgagcttccgacggattggagctggaggtgaggacggaggacagggtgggcctgctgtcggagatcacgcgcgtgttccgggagaatagcctgtccatcatccgcgcggcgatcgcgaccagggacggcagggcggaggacacgttctacgtgtcggacgcgtacggcaaccccgtcgacggccggaccgtggacgcggtgggcgagcagctcgggcacgccgtgctgcgggtgaagcgcggcggcggtggccgcggcccgcccgtggccgagggcggcgcggtgtccgtcctgggcagcctgctgaagggctcgttccagggtctcaggctgatcaggtcctattcataatccaaggattctgattagttacacgaccgggcagtgctttgtggtttgtacatacaaatctgacgtaggttagggaataatgaagcagaagggcgtggatgctgcattgtacatttgcacaggaagtcacatgtcattaccagcattattgtgaattagcaatacaattacaggttagcagaaatttagccatttcatgaggccatttaacgaggaatccatgaggtactgggaattagcaatacagttacaagttagcagaaatttagcacgttctatgaaggcctatgtg

SEQ ID NO: 5142 - DNA, 1635 bp, Zea mays
cgcgctgctcgcgcatgctataaagccggcagaacagcgagctgccttcctcgccgtggagtagaggagcacaagtgagctagctagctctagctaggccacgcactgctgcctccttcatcatcaggtcgtgctagctagctagctatagctgggccgggggacgtacgacatcagcgcgcggccatgggcgtggggaagctgatgaacgacgtgaagccatacctggcgatggtgctgctgcaggtggggttctccgggatgtacatcgtctccgtcgcctccctcaagcgcggcatgaaccacttcgtcctcgtcgtctaccgcaacctcgtcgccaccgtcgtcatggcccccttcgccctcctcttcgagaggcgagtgaggcccaagatgacgccgctcatcttcctcaagatcatggggctcgccgtgctcgagcctgtgctcgaccagaacatgtactacctcggcgcgaagctgacgtccgcgaccttcgcctcggcgctggtcaacatcctccccgccatcacgttcctgctggccctcgccctgaggatggagaggctgaggctccggagcctccgcagccaggccaaggtggtcggcacggtctgcaccgtcgccggcgccgtgctgatgatcctctaccacggcccggtggtgccgttcccgtggtccgcgggtcgtcttcaccaccacgtccccgcggcggcggtggagagccagagcagcgcctcctggctcaacggcatctgcatgatcatcggcagctgcctgtgctggtccggcttcttcatcctccagtcgaacacgctgcagagctaccctgcggagctgacgctgacgactctgatctgcttcctgggctcggtgctgaccggcggcgtggcgctcgtggcggagcgccgcgacatgagcgcctgggtcattggcttcgacacccgcctcttcaccgccgtctactccgggatcgtgtgctccggcgtggccttctacgtgcaggggatcgtgacgcaggcgcgcgggccggtgttcgtgacggcgttccagcccctgtgcatgatcatcaccacggttcttggctccaccatactgaaagaggagaccaccctgggaagcgtgattggcgcggcgatcatagtggtggggctctactgcctcatctggggcaagagcaaggaccacctcggcagcaacggcggcaagcccggcgccgcggccgtcgccgagctgcccctgacctcgtcggctcctgcttggtccaacggcaagcaagctctggccgtcgtcgagacgacaccgccttcgtctttgcccaacaagtgcgttcactgacgcgcggatcggagctccatgcatgatgcggaccgtacaccaccgcacactactagtagtgcattgccagtgactgtaagccgccggccgtgtatgatcatgcatgcataccgatgtcccatactcccatcgttgcgtttaacactctcgagtttttgataacgtacttgcgtgtgctctgctgtgtgccactgccagtgccaccacaaccaatagtctaatactactacgacaattaagctttgtttagtttgtgcaaggaaagaagagaattaattactactattcgagtcgatc

SEQ ID NO: 5143 - DNA, 1599 bp, Hordeum vulgare
cggcacgaggcacctccaaccaatttaactttcgtgaatcttcgatcgcttttcatttggcccagctcgacgtcacgcggatgtccccgatggatctcgccggccacacgcccctcgacgacgacgagatgagcagcgtgtgatcctcgtcgccccgtccatccaaccgaagataagacgcccactccctcccttccacatggcacccaccctccaatcccttacttattcccgcccccctcactcctccatcccctagctccacctctcatccgctcctcagccacacctagagcatcttagctccagctagccaccaatggccgccgcactgagcctccgcgcgcccttctccgtgcgcgctgtggcgccaccggcgccccgcgtggcccttgcgcccgcggccctcagcctcgccgccgccaagcaggtgcggggagccaggctccgcgcgcaggcgacgtacaaggtgaagctggtgacgcccgagggcgaggtggagctggaggtccccgacgacgtctacatcctggaccaggccgaggaggagggcatcgacctgccctactcctgccgcgccggctcctgctcctcctgcgccggcaagttggtgtccggcgagatcgaccagtccgaccagagcttcctcgacgacgaccagatggaggcagggtgggtgctcacctgccacgcctaccccaagtccgacatcgtcatcgagacccacaaggaggaggagctcaccgcataagctgcttaccctgcctctctttgcaacaagatcgagctgatatcatattatctcccatcatgcatgcatgcatggatatcgccagatacaccgatttgtttgtgctcgaatgaattgctcgatgcatggtttgctccagtaataatgtcttcgaattactacctttttgtaccgtaagatatactactgtcgtaatactagcgtgtacttaattcaacgtactgaaatgaatcctgatggctgaggtgtctctctgattaaaaaaaaaaaaaaatacaaaaatataccagacaaagaaaccaacaaacataaaacttataaacactgaacaaaaaaatgaccaaatcctggggggggggcccggtccccatttcgccctatggggagcgctataaaattcaccgggcccgggtttaacaacgcgagactggaaaaaccgggcggttcccaattaatccccttggaaaaatccccttttgcaactggggaaaaacaaaaaggccccccgattcgccttccaaaagtggcaacccgaatgggaaaggcaaatgtaagctaaattttgggaaaattcgggtatttttggaaaacactatttttaaccaaagggcgaaacgggaaaacccttttattaaaaaaataccgaaatagggtgagttttcccatttggaaaagaagccccataaaaaacgggccccacggcgagggcaaaacgtgtttgagggagagccccggggggaacctcccctaatactactaggtggggaggccgcgcgctggaggggcctctggagccctggcttaggggcggggaacgcccacgcgcgaaagaaggaagaagggggggg

SEQ ID NO: 5144 - DNA, 1857 bp, Secale cereale
aaggttctcccgcgtcagggagtagttggcgccatcgcccttgccttctttagctagctagcccacgcgcatacatacatacttacacgagaaagagaaagagaaaagattcattcacgggtggaggaggaggaagaagaagagctcgatgggggacgaccatggcgccaagctggtgaagagcctgaggggcgcggcgcagaagtacgtcggcgtcggcttcttcctcggcttcttcctcgtcctcctcacctacttcaccgtctccgagcagttcgccatcgccgctcccaacgctatccggaggacctcgccggggcaccagacgccgaccgcccccgccgtggcagacaagacggtgcagcagcagcagctccccgtcaaaaaggaggaagcacctctgccagagcaggagcaagtaccacctgtcgacgaggagccccacagagaaacagaggagcccaactctgaaacagaggaggaccccaagcccaccgatgaggctagcaagatcgtgacgacggcggcggaggagagcgcgccggcgaagaagccggcgtgcgacatccaggggccgtgggcgtccgacgtctgcgacctcgccggcggcagcgggggcgtgcgcatccacggctccacgcacacggtgctcgtcccgcccaccatcgagtccggcggcagcaaccccaacccgcaggagtggcgcgtgctgccctactcccgcaagcacatgtccggcatcaaggagatcactgtgcgcgagctgcccacggcggccgacgcgccgaggtgcgccgtcacctcgcaggtccccgcgctcgtcttcgccatgggcggcctcacgggcaactactggcacgacttcagcgacgtcatgatcccgctctacctccaggcctcccgcttcgacggcgaggtgcagctcgtggtcaccaacatccagccatggtacgccggcaagtaccgccacatcatcgcccgcctctcgcgctacgacgtcgtcgacatggacaaggacgaccaggtgcgctgcttcccctccgccgtcgtcggcatccgcatgcacaaggagttcagcatcgacccggccaaggagcccacgggtcactccatgcccgagttcaccaagttcctccgcagcgcttcgcggtcccgcgcgccgcgcccatgcgggtcaccgccgggagcaacaagaagccgaggatgatgatcatctcccggcgccacccgaggaagctcgtcaacgtggcggaggtggtggcgctggccaagcggatcgggttcgaggtggtcatcggggacccgccgttcaacgtggacgtgggcgacttcgcgcgcgaggtgaacgccgccgacgtgctcatgggggtgcacggcgccggcctcaccaactcgctcttcctgcccacgggggccgtcttcatccaggtgaaccccttcggcaagatggagcacatcggggaggtcgacttcggggcgccggcggtggacatggggctcaagtacatggcctactcgtgcggcatggaggagagcacgctggtggacacgctcgggcgcgaccacccggcggtcaaggacccggagtcgatccaccgcagcggctggggcaaggtggccgagtactacctcggcaagcaggacgtgaagctcgacctccagcgcttcgagcccgtgctcctcaaggccatggccatgctcagagagtagctagacgctccctcggtcgagcttcattggttgattcgcactagcgtagagctgtccattcttctaatttattcctattaatttacataattttgggtggatatagtgatctaaaggtttattacagtatatatgtgttccactgta

SEQ ID NO: 5145 - DNA, 1809 bp, Secale cereale
atacatacttacacagaaagagaaagagaaagagaaagaattcattcacgggtggaggaggaggaggaagaagaagagatcgatgggggacggaccgatggcggcaagctggtgaagagacctgaggggcgcggcgcacaagtacgtcggcgtcggcttcttcctcggcttcttcctcgtcctcctcacctacttcaccgtctccgagcagttcgccatcgccgctcccaacgctatccggaggacctcgccggggcaccagacgccgaccgcccccgccctggcagacaagacggtgcagcagcagcagctccccgtcaaaaaggaggaagcacctctgccagagcaggagcaagtacaagagaagccaccgcctgtcgacgaggagccccacagagaaacagaggagcccaactctgaaacagaggaggaccccaagcccaccgatgaggctagcaagatcgtgacgacggcggcggaggagagcgcgccggcgaagaagccggcgtgcgacatccaggggccgtgggcgtccgacgtctgcgacctcgccggcggcagcgggggcgtgcgcatccacggctccacgcacacggtgctcgtcccgcccaccatcgagtccggcggcagcaaccccaacccgcaggagtggcgcgtgctgccctactcccgcaagcacatgtccggcatcaaggagatcacggtgcgcgagctgccctcggcggccgacgcgccgaggtgcgccgtcacctcgcaggtccccgcgctcgtcttcgccatgggaggcctcacgggcaactactggcacgacttcagcgacgtcatgatcccgctctacctccaggcctcccgcttcgacggcgaggtgcagctcgtggtcaccaacatccagccatggtacgccggcaagtaccgccacatcatcgcccgcctctcgcgctacgacgtcgtcgacatggacaaggacgaccaggtgcgctgcttcccctccgccgtcgtcggcatccgcatgcacaaggagttcagcatcgacccggccaaggaccccacgggccactccatgcccgagttcaccaagttcctccgcagcgtcttcgcgctcccgcgcgccgcgcccatgcgggtcaccgccgggagcgacaagaagccgaggatgatgatcatctcccggcgccacccgaggaagctcgtcaacgtggcggaggtggtggcgctggccaagcggatcgggttcgaggtggtgatcggggacccgccgttcaacgtggacgtgggcgacttcgcgcgcgaggtgaacgccgccgacgtgctcatgggggtgcacggcgccggcctcaccaactcgctcttcctgcccacggggggccgtcttcatccaggtgaacccccttcggcaacatggagcacatcggggaggtggacttcgggggcgccggcggtggacgatgggcctcaagtacatggcctactcgtgcggcatggaggagagcacgctggtggacacgctcgggcgcgaccacccggcggtcaaggacccggagtcgatccaccgcagcggctggagcaaggtggccgagtactacctcggcaagcaagacgtcaagctcgacctccagcgcttcgagcccgtgctccgcaaggccatggccatgctcagagagtagctacacgctccctccggtcgagcttcattggttgattcgcactagcgtagagctgttccatttcttctaatttattcctattaatttacataattttggggtggatatagtgatcaaaaggtttatacagtatatatgtgttcca

SEQ ID NO: 5146 - DNA, 1938 bp, Leymus cinereus x Leymus triticoides
  misc_feature (429)..(429): n is a, c, g, or t
  misc_feature (437)..(437): n is a, c, g, or t
  misc_feature (455)..(455): n is a, c, g, or t
  misc_feature (468)..(468): n is a, c, g, or t
  misc_feature (475)..(475): n is a, c, g, or t
  misc_feature (492)..(492): n is a, c, g, or t
  misc_feature (962)..(962): n is a, c, g, or t
  misc_feature (999)..(999): n is a, c, g, or t
  misc_feature (1496)..(1496): n is a, c, g, or t
  misc_feature (1515)..(1515): n is a, c, g, or t
  misc_feature (1521)..(1521): n is a, c, g, or t
  misc_feature (1647)..(1647): n is a, c, g, or t
  misc_feature (1729)..(1729): n is a, c, g, or t
  misc_feature (1798)..(1798): n is a, c, g, or t
  misc_feature (1830)..(1830): n is a, c, g, or t
gaaggttctcccgcgtcagggagttgttgacaccatcgccgtaaccttctttagctagctaggacacccgcacacgcgcatacatacacgagaaagagaaagagataggattcattcacgggaggaggaggaagagatagggggagagagatgggggacgaccacggcgcgaagctggtgaagagcctgcggggcgcggcgcagaagtacgtcggcgtcgggttcttcctcggcttcttcctcgtcctcctcacctacttcaccgtctccgagcagttcgccatcgctgcgcccaacgctatccagaggagctcgccggcgcacccgacgccgaccgccccggccgtggcagagaagacggcgcagcagcagcagcagctccccgtcaaaaaggaggaagcacctttgccagaacaagtacaagagaanccccctcntgtcgacgaggaaccgcncacagaaacagangaggacnagacgccccacacaganacagaggagggccagaaacccatcgatgacgctagcaagatcgtgacgacggcggaggagagcgcgccggcgaagaagccggcgtgcgacatccaggggccctgggcctcggacgtctgcgacctcgccggcggcagcgggggcgtgcgcatccacggctcgacgcacacggtgctcgtcccgcccaccatcgagtccggcggcagcaaccccaacccgcaggagtggcgcgtgctgccctactcccggaagcacatgtccggcatcaaggagatcaccgtgcgcgagctggccacggcggccgacgcgccccggtgcgccgtcacgtcgcaggtccccgcgctggtcttcgccatgggcggcctcaccggcaactactggcacgacttcagcgacgtcatgatcccgctctacctccaggcctcgcgcttcgacggcgaggtgcagctcgtggtcaccaacatccagcnctggtacgccggcaagtaccgccacatcatcgcccgnctctcgcgctacgacgtcgtggacatggacaaggacgaccaggtgcgctgcttccccagcgccgtcgtcggcatccgcatgcacaaggagttcagcatcgacccgaccaaggagcccacgggccactccatgcccgagttcaccaagttcctccgcaacgtcttcgcgctcccgcgcgccgcgccgatgagggtcaccgccgggagcgacaagaagccgaggatgatgatcatctcgcgccggcacccgaggaagctagtcaacgtggcggaggtggtggcgctggccaagcggattgggttcgaggtggtgatcggggacccgccattcaacgtggacgtgggcgacttcgcccgggaggtgaacgccgccgacgtgctcatgggggtgcacggcgctggcctgaccaactcgctgttcctgccgacgggggcggtgttcatccaggtgaaccccttcggcaagatggagcacatcggggaggtggacttcggggngccggcggtggacatgggnctcaantacatggcctactcatgcgggatggaggagagcacgctggtggacacgctggggcgcgaccacccggcggtcaaggacccggagtcggtgcaccgcagcgggtggaacaaggtggcggagtactanctcggcaagcaggacgtgaagctcgacctccagcggttcgagcccgtgctcctcaaggccatggccatgctcagagagtagncgctccctccgatcgagcttgcagcccacgcgcactggttgctgattcgcactagcttagagcagttcnattccttctaatttattccttattaatttacnttttttttgtgtggatgggctgatcaaaaggtttatacggtatatatatgtgttccactgatcgatcgatccacagagcaatacgaaaccttgattatgtaaaaaaaa

SEQ ID NO: 5147 - DNA, 1936 bp, Hordeum vulgare
agagaagggaactggtccgtggagaggtgttcttggaaggttctcccgcgtcagggagtagctggcgccatcgccgctaccttctttagctagttagctagacacacgcacacgcgcatacatacacgagaaagataaagataaagagaaagagaaagattcattcacgggaggaggaagaagagagatgggggacgaccatggcgccaagctggtgaagagcctgcggggcgcggcgcagaagtacgtcggcgtcggcttcttcctcggcttcttcctcgtcctcctcacctacttcaccgtctccgagcagttcgccatcgccgcgcccaacgctatccggaggacctcgccggggcacccgacgccgacctccccagccgtggcagagaagacggtgcagcagcagcagctcccggtcaaaaaggaggaagcacctctgccagagcatgaacaagtacatgagaagccaccgcctgtcgacgacgacgaggagccccacagagaaacagaggagcccaactcccaaacagagcaccccatcgatgaggctagcaagatcgtgacgacggcggaggagagcgcgccggcgaagaagccggcgtgcgacatccaggggccgtgggcgtccgacgtgtgcgacctcgccggcggcagcgggggcgtgcgcatccacggctccgcccacacggtgctcgtcccgcccaccatcgagtccggcggcagcaaccccaacccgcaggagtggcgcgtgctgccctactcccgcaagcacatgtccggcatcaaggagatcaccgtgcgcgagctggccacgcccgccgacgcgccccgctgcgccgtcacctcccaggtccccgcgctcgtcttcgccatgggcggcctcacggggaactactggcacgacttcagcgacgtcatgatcccgctctacctccaggcctcccgcttcgacggcgaggtgcagctcgtggtcaccaactaccagcgctggtacgccggcaagtaccgccacatcatcgcccgcctctcccgctacgacgtcgtggacatggacaaggacgaccaggtccgctgcttcccctccgccgtcgtcggcatccgcatgcacaaggagttcagcatcgacccggccaaggagcccacgggccactccatgccggagttcaccaagttcctccgcaacgtcttcgcgctcccgcgcgccgcgcccatgggcgtcaccgccggaccgagcgacgggaaaaaaaagcccgaggatgatgatcatctcccggcgccacccgaggaagctggtgaacgtggacgaggtggtggccctcgccaagcggatcgggttcgaggtggtgatcggggacccgccgttcaacgtggacgtcggcgacttcgcgcgggaggtgaacgccgccgacgtgctcatgggggtgcacggcgccggcctgaccaactcgctcttcctgcccacgggggcggtgttcatccaggtgaaccccttcggcaagatggagcacatcggggaggtggacttcgggacgccggcggtggacatggggctcaagtacatgtcctactcgtgcggcatggaggagagcacgctggtggacaccctggggcgcgaccacccggcggtcaaggacccggagtcgatccaccggagcgggtggaacaaggtggcggagttctacctcggcaagcaggacgtcaagctcgacctccagaggttcgagcccgtgctcctcaaggccatggcgatgctcagagagtagctacgctccctccctcggatcgaccttgcagccgactagcttagagcagtttcattccttctaatttattcctattaatttacactttttttgtgtgtgtggatggactgatcaataggtttatacggtatatatgtgctccactggtccatcggtccacagagcaatac

SEQ ID NO: 5148 - DNA, 1767 bp, Secale cereale
gaaagcgaaagagttcacttcacggggtgaggaggagaggaagaggaacagatccggatgggggcgacaccggcggcaagctaggtgaagagcctcaggggcccgcgcacagacttcggcgtcgcttcttcctcggcttcttcctcgtcctcctcacctacttcaccgtctccgagcagttcgccatcgccgcgcccaacgctatccggaggacctcgccgggcaccagacgccgacggccccgcgtggcagacagacggtgcagcagcagcagctcccgtcaaaaaggaggaagcacctctgccagagcaggagcaagtacaagagaagccaccgcctgtcgacgaggagccccacagagaaacagaggagcccaactctgaaacagaggaggaccccaagcccaccgatgaggccagcaagatcgtgacgacgacggcggaggagagcgcgccggcgaagaagccggcgtgcgacatccaggggccctgggcgtccgacgtctgcgacctcgccggcggcagcgggggcgtgcgcatccacggctccacgcacacggtgctcgtcccgcccaccatcgagtccggcggcagcaaccccaacccgcaggagtggcgcgtgctgccctactcccgcaagcacatgtccggcatcaaggagatcacggtccgcgagctgcccacggcggccgacgcgccgaggtgcgccgtcacctcgcagggccccgcgctcgtcttcgccatgggcggcctcacgggcaactactggcacgacttcagcgacgtcatgatcccgctctacctccaggcctcccgcttcgacggcgaggtgcagctcgtggtcaccaacatccagccatggtacgccggcaagtaccgccacatcatcgcgcggctgtcgaggtacgacgtcgtggacatggacaaggacgaccaggtgcgctgcttcccctccgccgtcgtcggcatccgcatgcacaaggagttcagcatcgacccggccaaggagcccacgggccactccatgcccgagttcaccaagttcctccgcagcgtcttcgcgctcccgcgcgccgcgcccatgcgggtcaccgccgggagcaacaagaagccgaggatgatgatcatctcccggcgccacccgaggaagctcgtcaacgtggcggaggtggtggcgctggccaagcggatcgggttcgaggtggtcatcggggacccgccgttcaacgtggacgtgggcgacttcgcgcgcgaggtgaacgccgccgacgtgctcatgggggtgcacggcgccggcctcaccaactcgctcttcctgcccacgggggccgtcttcatccaggtgaacccctcggcaacatggagcacatcggcgaggtcgacttcggggcgccggcggtggacatggggctcaagtacatggcctactcgtgcggcatggaggagagcacgctggtggacacgctcgggcgcgaccacccggccgtcaaggacccggagtcgatccaccgcagcggctggggcaaggtggccgagtactacctcggcaagcaggacgtcaagctcgacctccagcgcttcgagcccgtgctccgcaaggccatggccatgctcagagagtagctacacgctccctccggtcgagcttcattggttgattcgcactagcgtagagctgttccatttcttctaatttattcctattaatttacataatttttgggtggatatagtgatcaaaaggtttatacagtatatatgtgttcca

SEQ ID NO: 5149 - DNA, 1539 bp, Secale cereale
ccagacgccgaccgcccccgccgtggcagacaagacggtgcagcagcagcagctccccgtcaaaaaggaggaagcacctctgccagagcaggagcaagtaccacctgtcgacgaggagccccacagagaaacagaggagcccaactctgaaacagaggaggaccccaagcccaccgatgaggccagcaagatcgtgacgacggcggcggaggagagcgcgccggcgaagaagccggcgtgcgacatccaggggccgtgggcgtccgacgtctgcgacctcgccggcggcagcgggggcgtgcgcatccacggctccacgcacacggtgctcgtcccgcccaccatcgagtccggcggcagcaaccccaacccgcaggagtggcgcgtgctgccctactcccgcaagcacatgtccggcatcaaggagatcaccgtgcgcgagctgccctcggcggccgacgcgccccgctgcgccgtcacctcgcaggtccccgcgctcgtcttcgccatgggaggcctcacgggcaactactggcacgacttcagcgacgtcatgatcccgctctacctccaggcctcccgcttcgacggcgaggtgcagctcgtggtcaccaacatccagccatggtacgccggcaagtaccgccacatcatcgcccgcctctcgcgctacgacgtcgtcgacatggacaaggacgaccaggtgcgctgcttcccctccgccgtcgtcggcatccgcatgcacaaggagttcagcatcgaccccgccaaggaccccacgggccactccatgcccgagttcaccaagttcctccgcagcgtcttcgcgctcccgcgcgccgcgcccatgcgggtcaccgccgggagcaacaagaagccgaggatgatgatcatctcccggcgccacccgaggaagctcgtcaacgtggcggaggtggtggcgctggccaagcggatcgggttcgaggtggtcatcggggacccgccgttcaacgtggacgtgggcgacttcgcgcgcgaggtgaacgccgccgacgtgctcatgggggtgcacggcgccggcctcaccaactcgctcttcctgcccacgggggccgtcttcatccaggtgaaccccttcggcaacatggagcacatcggcgaggtcgacttcggggcgccggcggtggacatgggcctcaagtacatggcctactcgtgcggcatggaggagagcacgctggtggacacgctcgggcgcgaccacccggccgtcaaggacccggagtcgatccaccgcagcgggtggagcaaggtggccgagtactacctcggcaagcaggacgtcaagctcgacctccagcgcttcgagcccgtgctccgcaaggccatggccatgctcagagagtagctagacgctccctccggtcgagcttcattggttgattcgcactagcgtagagctgttccatttcttctaatttattcctattaatttacataattttggggtggatatagtgatcaaaaggtttatacagtatatatgtgttccactga

SEQ ID NO: 5150 - DNA, 1609 bp, Secale cereale
aggaggaagcacctctgccagagcatgagcaagtaccacctgtggacgaggagccccacagagaaacagaggagcccaactctgaaacagaggaggaccccaagcccaccgatgaggccagcaagatcgtgacgacggcggcggaggagagcgcgccggcgaagaagccggcgtgcgacatccaggggccgtgggcgtccgacgtctgcgacctcgccggcggcagcgggggcgtgcgcatccacggctccacgcacacggtgctcgtcccgcccaccatcgagtccggcggcagcaaccccaacccgcaggagtggcgcgtgctgccctactcccgcaagcacatgtccggcatcaaggagatcaccgtgcgcgagctgcccacggcggccgacgcgccacgctgcgccgtcacctcgcaggtccccgcgctcgtcttcgccatgggcggcctcacgggcaactactggcacgacttcagcgacgtcatgatcccgctctacctccaggcgtcccgcttcgacggcgaggtgcagctcgtcgtcaccaacatccagccctggtacgccggcaagtaccgccacatcatcgcccgcctctcgcgctacgacgtcgtcgacatggacaaggacgaccaggtgcgctgcttcccctccgccgtcgtcggcatccgcatgcacaaggagttcagcatcgacccggccaaggagcccacgggccactccatgcccgagttcaccaagttcctccgcagcgtcttcgcgctcccgcgcgccgcgcccatgcgggtcaccgccgggagcgacaagaagccgaggatgatgatcatctcccggcgccacccgaggaagctcgtcaacgtggcggaggtggtggcgctggccaagcggatcgggttcgaggtggtcatcggggacccgccgttcaacgtggacgtgggcgacttcgcgcgcgaggtgaacgccgccgacgtgctcatgggggtgcacggcgccggcctcaccaactcgctcttcctgcccacgggggccgtcttcatccaggtgaacccctacggcaagatggagcacatcggggaggtggacttcggggcgccggcggtggacatggggctcaagtacatggcctactcgtgcggcatggaggagagcacgctggtggacacgctcgggcgcgaccacccggcggtcaaggacccggagtcgatccaccgcagcggctggggcaaggtggccgagtactacctcggcaagcaggacgtcaagctcgacctccagcgcttcgagcccgtgctccgcaaggccatggccatgctcagagagtagctacacgctccctccggtcgagcttcattggttgattcgcactagcgtagagctgttccatttcttctaatttattattcctattaatttacataattttggggtggatatagtgatcaaaaggtttatacagtatatatgtgttccactgatcgatcacagagcaatacgatccttgatcatatatagtgccatcatgaactacctctccaattaaaaaaaaatcatccagaactaacccttcaaggcatatttttgtggaagaaactctaagtaccacgaac

SEQ ID NO: 5151 - DNA, 1682 bp, Secale cereale
ggacgaccatggcggcaagctggtgaagagcctgcggggcgcggcgcacagtacgccggcgtggggttcttcctcggcttctcctcgtcctcctcacctacttcaccgtctccgagcagttcgccatcgccgcgcccaacgctatccggaggacctcgccggggcaccagacgccgaccgcccccgccgtggcagacaagacggtgcagcagcagcagctccccgtcaaaaaggaggaagcacctctgccagagcatgagcaagtaccacctgtggacgaggagcccccacagagaaacagaggagcccaactctgaaacagaggaggaccccaagcccaccgatgaggctagcaagatcgtgacgacggcggaggagagcgcgccggcgaagaagccggcgtgcgacatccaggggccctgggcgtccgacgtctgcgacctcgccggcggcagcggcggcgtgcgcatccacggctccacgcacacggtgctcgtcccgcccaccatcgagtccggcggcagcaaccccaacccgcaggagtggcgcgtgctgccctactcccgcaagcacatgtccggcatcaaggagatcactgtgcgcgagctgccctcggcggccgacgcgccccgctgcgccgtcacctcgcaggtccccgcgctcgtcttcgccatgggcggcctcacgggcaactactggcacgacttcagcgacgtcatgatcccgctctacctccaggcctcccgcttcgacggcgaggtgcagctcgtggtcaccaacatccagccatggtacgccggcaagtaccgccacatcatcgcccgcctctcgcgctacgacgtcgtcgacatggacaaggacgaccaggtgcgctgcttcccctccgccgtcgtcggcatccgcatgcacaaggagttcagcatcgacccggccaaggagcccacgggtcactccatgcccgagttcaccaagttcctccgcagcgtcttcgcgctcccgcgcgccgcgcccatgcgggtcaccgccggacctgtaagcgacaagaagccgaggatgatgatcatctcgcgccgccacccgaggaagctggtgaacgtggcggaggtggtggcgctcgccaagcggatcgggttcgaggtggtcatcggggacccgccgttcaacgtggacgtgggcgacttcgcgcgcgaggtgaacgccgccgacgtgctcatgggggtgcacggcgccggcctcaccaactcgctcttcctgcccacgggggccgtcttcatccaggtgaaccccttcggcaagatggagcacatcggggaggtcgacttcggggcgccggcggtggacatgggcctcaagtacatggcctactcgtgcggcatggaggagagcacgctggtggacacgctcgggcgcgaccacccggccgtcaaggacccggagtcgatccaccgcagcggctggggcaaggtggccgagtactacctcggcaagcaggacgtcaagctcgacctccagcgcttcgagcccgtgctccgcaaggccatggccatgctcagagagtagctacacgctccctccggtcgagcttcattggttgattcgcactagcgtagagctgttccatttcttctaatttattattcctattaatttacataattttggggtggatatagtgatcaaaa

SEQ ID NO: 5152 - DNA, 1382 bp, Secale cereale
tcacctacttcaccgtctccgagcagttcgccatcgccgcgcccaacgctatccggaggacctccggggcaccagacgccgaccgcccccgccgtggcagacaagacggtgcagcagcagcagctccccgtcaaaaaggaggaagcacctctgccagagcaggagcaagtaccgcctgtcgacgaggagccccacagagaaacagaggagcccaactcagaaacagaggaggaccccaagcccaccgatgaggctagcaagatcgtgacgacggcggcggaggagagcgcgccggcgaagaagccggcgtgcgacatccaggggccgtgggcgtccgacgtctgcgacctcgccggcggcagcgggggcgtgcgcatccacggctccacgcacacggtgctcgtcccgcccaccatcgagtccggcggcagcaaccccaacccgcaggagtggcgcgtgctgccctactcccgcaagcacatgtccggcatcaaggagatcaccgtgcgcgagctgcccacggcggccgacgcgccgaggtgcgccgtcacctcgcaggtccccgcgctcgtcttcgccatgggaggcctcacgggcaactactggcacgacttcagcgacgtcatgatcccgctctacctccaggcctcccgcttcgacggcgaggtgcagctcgtcgtcaccaacatccagccatggtacgccggcaagtaccgccacatcatcgcgcggctctcgcgctacgacgtcgtggacatggacaaggacgaccaggtgcgctgcttcccctccgccgtcgtcggcatccgcatgcacaaggagttcagcatcgaccccgccaaggaccccacgggccactccatgcccgagttcaccaagttcctccgcagcgtcttcgcgctcccgcgcgccgcgcccatgcgggtcaccgccgggagcaacaagaagccgaggatgatgatcatctcccggcgccacccgaggaagctcgtcaacgtggcggaggtggtggcgctggccaagcggatcgggttcgaggtggtcatcggggacccgccgttcaacgtggacgtgggcgacttcgcgcgcgaggtgaacgccgccgacgtgctcatgggggtgcacggcgccggcctcaccaactcgctcttcctgcccacgggggccgtcttcatccaggtgaacccctacggcaagatggagcacatcggggaggtggacttcggggcgccggcggtggacatggggctcaagtacatggcctactcgtgcggcatggaggagagcacgctggtggacacgctcgggcgcgaccacccggccgtcaaggacccggagtcgatccaccgcagcgggtggagcaaggtggccgagtactacct

SEQ ID NO: 5153 - DNA, 2062 bp, Sorghum bicolor
atggagatggaagcggtggtggtggcggcggccgccctgtgcggcgcgctggcgctctacctgtaccacgcgctgtgggtggcgcccgagcgggtgcgcgccgcgctgcgggcgcagggcgtcgcggggccgcgcccctccttcccctacggcaaccgcgccgacatgaggcgggcggccgcggccgcggccgcggtggcgccagcagcagggacgacgcagcgcggcggcatcgtgcacgactaccggcaggcgctgttcccgcactacgagaggtggaggaaggagtacggcccgatcttcacctactcgatcgggagcatggtgttcctgcacgccagccgggcggacgtggtccgggacctcggccgctgcgggacgtcgctggacctcggcaagagctcctacatgaaggtcacgcaccggccgctcttcggtgacggcatcctcaagtccagcggcgaggcctgggcgcaccagcggagtctcatcgcgcccgagttctgccccaacaaggtcaagggcatggtggacctcatggtcggctcggccacggcgctggtggcgtcgtgggaggacaggatcagcagcggtggcggtggcggtggcgcggagctcgagctcaagatcgacgacgacatcagggcctactccgccgacgtcatctccaggacgtgcttcggcagcagctacgtcaagggcaagcggatcttcgcggcgatcagggagctgcagaaggcggtgtccaagcccaacctgctggcggagatgacaggactcagcttcctcccgacgaggaccaacacagaggcgtggaggctcaacagggtcgtgcgggacctggtcctggacgtcgtcagggagagcgggggcgacgacaggaacctgctcaacgcgatgctccgcagcgccgcggcggagtccggcggcggcggccgcgtggcggcggtggaggagttcgtcgtggacaactgcaagaacatctacttcgccgggtacgagaccacggcggtgaccgccgcctggtgcacgatgctcctggcgctgcacccggagtggcaggaccgggtgcgcgacgaggcgcggcaggcgtgcgcggccggcgccgcgccggacttcgcatccctgcacaagatgaagaagctgacgatggtgatccaggagacgctgcggctgtacccggccggctcggtggtgtcgaggcaggcgctccgcgacgtcaccctcggcggcgtgcgcgtgccggccggcgtcaacatctacgtgccggtctcgacggtgcacctggacccggagctgtggggcgccgacgcgggggagttcgacccggggcggttcgcggacgacgcgcaccaccagcggcagccgcacgcgtacctccccttcggcgccggcgcgcgcatctgcctcggccaggccttcgccatggccgagctcaaggtcctgctggcgctcgtgctgtccaggttccacatcagcctgtcgccggcctacgtgcactcgccggcgctcaggctcatcgtggagcccgagcacggcgtgcggctcgtgctcaggaacgtggagcccagcccaggtgctagctagatgggcctgggcctgggcctcgttagtttcttccacgctgggcctcctcactgaaacggaagttcggcccagtcgctaataatctgctgggtggtcacggcgattgcattgtacagattggacagcaacagggtagatgtagaggatattcaaggtggtgtctgtttctgtcattcagattgtgtttttttaaaatacactcaacgtggcgcacgcacgcatatgcccttgctgcggtttgcgatttgcaagcatcagctaagcaaggcacttccatggtactactagcataccatattatggcttctctggatcagcactttctgtctgcttaaagtacctgtaatcaggggatgataagaataaatgttgcagctgagagccaagattaggtgaagaccgtgtggtcataatggggtgttctggacagtggacactagatagtacaaaagcatcattcctaaataatacatgg

SEQ ID NO: 5154 - DNA, 2176 bp, Sorghum bicolor
caacaccgccccaacgcatacacaaccagccggccagagggccaagttacgagcgagatggagatggaagcggtggtggtggcggcggccgccctgtgcggcgcgctggcgctctacctgtaccacgcgctgtgggtggcgcccgagcgggtgcgcgccgcgctgcgggcgcagggcgtcgcggggccgcgcccctccttcccctacggcaaccgcgccgacatgaggcgggcggccgcggccgcggccgcggtggcgccagcagcagggacgacgcagcgcggcggcatcgtgcacgactaccggcaggcgctgttcccgcactacgagaggtggaggaaggagtacggcccgatcttcacctactcgatcgggagcatggtgttcctgcacgccagccgggcggacgtggtccgggacctcggccgctgcgggacgtcgctggacctcggcaagagctcctacatgaaggtcacgcaccggccgctcttcggtgacggcatcctcaagtccagcggcgaggcctgggcgcaccagcggagtctcatcgcgcccgagttctgccccaacaaggtcaagggcatggtggacctcatggtcggctcggccacggcgctggtggcgtcgtgggaggacaggatcagcagcggtggcggtggcggtggcgcggagctcgagctcaagatcgacgacgacatcagggcctactccgccgacgtcatctccaggacgtgcttcggcagcagctacgtcaagggcaagcggatcttcgcggcgatcagggagctgcagaaggcggtgtccaagcccaacctgctggcggagatgacaggactcagcttcctcccgacgaggaccaacacagaggcgtggaggctcaacagggtcgtgcgggacctggtcctggacgtcgtcagggagagcgggggcgacgacaggaacctgctcaacgcgatgctccgcagcgccgcggcggagtccggcggcggcggccgcgtggcggcggtggaggagttcgtcgtggacaactgcaagaacatctacttcgccgggtacgagaccacggcggtgaccgccgcctggtgcacgatgctcctggcgctgcacccggagtggcaggaccgggtgcgcgacgaggcgcggcaggcgtgcgcggccggcgccgcgccggacttcgcatccctgcacaagatgaagaagctgacgatggtgatccaggagacgctgcggctgtacccggccggctcggtggtgtcgaggcaggcgctccgcgacgtcaccctcggcggcgtgcgcgtgccggccggcgtcaacatctacgtgccggtctcgacggtgcacctggacccggagctgtggggcgccgacgcgggggagttcgacccggggcggttcgcggacgacgcgcaccaccagcggcagccgcacgcgtacctccccttcggcgccggcgcgcgcatctgcctcggccaggccttcgccatggccgagctcaaggtcctgctggcgctcgtgctgtccaggttccacatcagcctgtcgccggcctacgtgcactcgccggcgctcaggctcatcgtggagcccgagcacggcgtgcggctcgtgctcaggaacgtggagcccagcccaggtgctagctagatgggcctgggcctgggcctcgttagtttcttccacgctgggcctcctcactgaaacggaagttcggcccagtcgctaataatctgctgggtggtcacggcgattgcattgtacagattggacagcaacagggtagatgtagaggatattcaaggtggtgtctgtttctgtcattcagattgtgtttttttaaaatacactcaacgtggcgcacgcacgcatatgcccttgctgcggtttgcgatttgcaagcatcagctaagcaaggcacttccatggtactactagcataccatattatggcttctctggatcagcactttctgtctgcttaaagtacctgtaatcaggggatgataagaataaatgttgcagctgagagccaagattaggtgaagaccgtgtggtcataatggggtgttctggacagtggacactagatagtacaaaagcatcattcctaaataatacatggtgaaaatgacagcgacgcgtgtgagctggacaacaacgctaaagctgcccccaaaac

SEQ ID NO: 5155 - DNA, 1586 bp, Saccharum officinarum
ctcacccggccaccagcaccccctcctcctcggcgcctccccaaccaggcaaccacagtaagcccctgccctttcctccccgacgcgcgcccctcatggcgaggaggcgctgctgatgcctcgcggcgtcggatcggacgcggcggccacgacacctagccgcttgcggtggcgctcgccgatccctacgcgcccaatccgccgacgctgctcctcggatcctccccgagggattcgagcctcgtctcgtctcctggtcttcaaggtgcgggggtgggatctgcctcggtttgcgttcttcccaagggccctgcccatactccagcagcggcccagtcgacttccccaggtgccgacccccacaaggtagcgcgcgcgtcacctcaaccccttgcatgcgctgacgctaaccctattcaggagacggagcagcgagtcagcggccacgacagcaaagagaggacggcagcctgcaagaagagaaggcccgtgtcaggcggcagccataggtgcaaggataggcaaccagtgcccaacaactcgtctgtggatcagttgacctgtatttcagcctttcagttgaggattaaagtagagctttaagaagcttgacaattggcatcatctcaagaatacattgaagtgcaagatgccaaaaataaagaatctctctaatgcatgtaaagtgtcattttctccacaaggtcccatatctgaagaggcacttgagagagtccgtgcactgttagatgagataagacctctagatgttggcctagataatgaagcacaaatcgcacgcaattggagtagttctacgcgtccatcaaatgggagacgaggacgtaatggggctaaccagttctctgctacaatcaaatatttgcacattcatgaatgtgaaagtttctctatgggtatattttgtatgccaccttcttcagttattccacttcatgatcatcctggaatgactgtacttagcaagcttctttatggaagactgcatgctgaatcttatgactgggttgatgtacctgatcatccaattgatcaattacaaacaaggccagccaagcttgttaaagattgtgaaatgactgctccagagacaactattctttaccctaatgcaggtggtaacattcacactttcagagccatcacaccttgtgctctctttgatgtcctttctccaccatactccgctgaggatgggcggcactgttcatacttccgaaagtctcaaatgaatcaaccacctgttgttttgcctgctgagatagatagctcacaagtaatttggttggaggaattggaggaccatcagcccccagaaggctttgttgttgcgagaggtctgtataaaggccctgttattaggagatgatttgctttggagcacagaatccaccaaactgcaaatcaactgaaagacgatgcgcttgtagtgtctattgcaagcattatcatgtcatgtgcagcctacgggttactttgtacatgtcaaagtgatctgtgataattaacggcaggttacagaacaagaatggatattttttgtttggctgcatttttaatgtgtc

SEQ ID NO: 5156 - DNA, 2144 bp, Zea mays
tacgctttaccataatctaatttatataatataggatagaaataagtaccgtaagttgataaaacgaattttaattgggaaatttggatccataccattaaaagatcactattttggatccataccattactatctcacctacatgtgggtccacatgagtcaatgacatgtggggtctatggtatatatctaaagtttagattttttaatggtatagatccaattgttccattttaatttgggacactatagatgcatttttggcactattggagatgtcttaggtcctgggcatcctagctcgcgcgtctctcacggtacctgctcctcggcgcctccccaaccaagcctccgcatcttcctctcgacgcgcccctcatggcgaggaggcgctgctgatgcctcccggcgtcggatcggacgcggcggccacgacacctagccgcttgcggtggtgctcgccgagctctacgcgcctaatccgccgacgctgctcctcggatcctccccgagagattcaggcctcgtctcgtctcgtcctgcctagcggttcaatcgacttccccaagtgcccgacccctacaaggtagtgcgcgtgcgtcgccccaaccccttgcatgcgctgacgctaaccctatctaggagacggagtggcgcgccagcggccacgccggcgaagagaggacgacagcgtgcaagaagagaaggcctgtgtcaggggcagctataggtggcaggtgcaaagataggcaacaagtgttcaacaacacgactgtggatcaattgacctgcatttcagcttttcagttgaggattaaagtggagctttaagaagcttgaaaattgacattatctcaataatacattgaagtgcaagatgccaaaaataaagaatctctctaatgcatgcaaagtatcattttctccggaaggtcccatatctgaagaggtgcttgagagagtccgtgcactgttagatgagataagacctctagatgttggcctagataatgaagcacaaattgcacgcaattggagtagtactacgcgtccatcaaatgggagacgaggacgtaatggggctaaccagttcactgctccaatcaaatatttgcacattcatgaatgtgaaagtttctctatgggtatattttgtatgccaccttcttcagttattccacttcataatcatcctggaatgacagtacttagcaagcttctttatggaagactgcatgctgagtcttatgactgggttgatgtacctgatcatcctattgatcaattgcaaccaaggccagccaagcttgttaaagattgtgaaatgacggctccagagacaactattctataccctaatgcaggtggtaacatccacacattcagagccatcacaccttgtgctctcttcgacgtcctttctccgccatactccgctgaggatgggcggcactgttcatacttccgcaagtctcaaatgaatcaaccatctgttgttttgcctgctgagatagatagcacacaagtagtttggttggaggagttggaggaccatcagcccccagaaggctttgttgttgcgagaggtatgtataaaggccctgtaattaggagataatttgctttggggcacagaatccaccaaactgcaaatcagctgaaagacgatattgcaagcatcctcaggtcatgtgcagcctacggtttactttgtacatgtcaaagtgacctgtgataattcaacagcagttttacaggacaagaatggatgtttttttgtttggttgcttttttaattgtgtcccactgctgtagtatctctgacctagttatggagctcttatcagaccaagaccgtggagcacctacttttgagcatagtctagcatattgtcatgatgtattgatgtactagggacatcaatggacaaccttttccatttggtgatttcagaaagagtttggttggggctaccattttgtctgtgtaatagcaccattactatttttgggcaagactgtaaattacgggggaggaactgtaataatatcgttagatttatcatgaaatatattttcacgatatacctatcatttttaataaaatcttaaacatcaatgttttttcataaactaagtcaaa

SEQ ID NO: 5157 - DNA, 2078 bp, Zea mays
gcagaaattgcttacagaagagaaatgacccgtttcgagccaaggcatcctcgcgtctcgctctcacccctcctcggcgcctccccgaccacagtgtaaagcccctgtcccttcctccccgactcgcccctcatggcgaggaggcgctgctgatgcctcgcggcgtcggatcggacgcggcggccacgacacctagccgcttgcggtggcgctcgcctacgcgcccaatccgccgacgctgctcctcggatcccccgagagattcaggccccgtctcgcctcgtcctgcctagtgcctaggtgaggctctggcctccaaaggtgcgtgggtgggatctgctgcctcggtttgcgttattcccaagtgccctgcccatactccaacagcggtccagtcgacttccccaagtgctcgacccctacaaggcagcgcgcgtgcgtcacctcaaccccttgcatgcgctggcgctaaccctatctaggagacggagcggcgggccagcggctacgcgggcaaagagaggacgagagcgtgcaagaagagaaggcccgtgtcaggcggcggctataggtgcaaggataggcaacaagtgttcaaaaacacgtctgtggatcaattgacttgtatttcagcctttcagttgaggattaaagtggaggtttaagaagcttgagaattggcatcatctcaagaatacattgaagtgcaagatgccaaaaataaagagtctatctaatgcatgccgagtatcattttctccagaaggtcccatatctgaagaggcgcttgagagagtccgtgcactgttagatatgataagacctctagatgtcggcctagataatgaagcccaaattgcacgcaattggagtagttctacgcgtccatcaaatgggagacgaggacgcaatggggctaaccagttcgcggctccaatcaaatatttgcacattcatgaatgtgaaagcttctctatgggtatattttgtatgccaccttcttcagttatcccacttcataatcatcctggaatgactgtacttagcaagcttctttatggacgtctgcatgctgaatcttatgactgggttgacatacctgatcatccaattgatcaattacaaacaaggccagccaagcttgttaaagattgtgaaatgactgctccagagacaactattctttaccctaatgcaggtggtaacatccacactttcagagccattacaccttgtgctctctttgacgttctttctccaccatactccgctgaggatgggcgacactgttcatacttccgaaagtctcagatgaatcagccacctgttgttttgcctgctgagatagatagctctcaggtagtttggttggaggagttggaggaccatcagcccccagaaggctttgttgttgcaagaggtctgtataaaggccctgtaattaggagataatttgctttggagcgcagaatcaaccaagctgcaaatcagctgaaagacgatgcaggcttgtagtgcctagtgcaagcatcgtcaggtcatgtgcagcctacggtttatttgtacatctcaaagtgatctttgataatttaacagcagttttacagaacaggaacggatgttttttgtttggctgccattttaactttgtcccactgctggagtatctctgacctagttatggagctcttatcagatcaagaccatggtacttttgatgtaccagcatagctattgtcatgatgtaccagggaagatcaagacaagtgtttccatttggtgatttcagaaagaatttggtgtggggctaccattttgtctgtgtaatagcagcattactattttggagcaagactgtaaattacgggagaggaactataataatatcattaggtttatcatgaaatatattttcatggtgtatctatttaggccttgtttggaaggagatctttttctgcattattgtcactgtgttccaaataggccgttaaagtttggtggtgacctagattgctgttagtctggtggggacctagaaatgaaagcgagtacagaagtccctcgctgccttagcg

SEQ ID NO: 5158 - DNA, 565 bp, Zea mays
acgtgacgtggctagcagcaactccatctccttttccggtcttcccgaccgagcgatccagccagcgagaggttgcgagaagtagccgccggaggagcacgccaaggccgccgcctacgaggacggccatggggttctgggtgaccacgctcatctttctcctcgccggcgtcgccgcatccctcttcacgctcctctgctgcaaccgcgggccctccacaaacctattccatttgaccttggtgactacagctgtaatttgttgttggatgatgtatgctatcgtttaccttgctcagatgaagccattgatcaaccccatcctgagcggggagtgatctctcctctgcattaaaaagaatgaaagctaggtctgctgtaccattattcagtctgtgaacttcctattcatttggccccacctgatgaaataaataaactgccatgagtttttttttttttgctactccttcactgcagacattgagaaggctcgctgtgattagtgtatgcaattgtatgatatacgcaataataataatagtatctaaatatctgtgtgccg

SEQ ID NO: 5159 - DNA, 770 bp, Sorghum bicolor
ggaagcacgcacgtgacgtggctggcagcaactccctccaccatctccttcccctgcagcacctgtcgcgtctccctccccgaccgagcgatccagcgagagggagcgagaagcagcagcagccgccggaggagctcgccgaggccgccgccgaagacgaccatggggttctgggttaccacgctcatcttcctcctcgccggcgtcgccgcatccctcttcacgctcctctgctgcaaccgcgggccctccacaaacctattccatttgaccttggtgactacagctgtaatttgttgttggatgatgtatgcaatcgtttaccttgctcagatgaagccattgatcaaccccatcctgagcggagagtgagctctgtctcttcattaaacagaatgaaagctagacctgctgtaccattattcagtctgtgaactttctattcattttggcgcacctgatgaaataaataaactgccatgagtttttttgctactctgcactccagacattgaggaggctcgctgtgattagtgtatgcaattgtatgatatacgcaataataaatatctatgtgtcgctcctgtgcttttattggaatgttttttgtcacgtgattgtctgcttgaattggaattgggaacataaaacgatgtagcacgatttgctgtttcagtgggtgattttgacttttgagctaaacatttgttggtggcactggtacactgctaatgtctgctactttcatgattgaaagttgaaagtacacc

SEQ ID NO: 5160 - DNA, 868 bp, Sorghum bicolor
ccaggaatcagtatctctttgcaagagtccatctcgagcccggaagcacgcacgtgacgtggctggcagcaactccctccaccatctccttcccctgcagcacctgtcgcgtctccctccccgaccgagcgatccagcgagagggagcgagaagcagcagcagccgccggaggagctcgccgaggccgccgccgaagacgaccatggggttctgggttaccacgctcatcttcctcctcgccggcgtcgccgcatccctcttcacgctcctctgctgcaaccgcgggccctccacaaacctattccatttgaccttggtgactacagctgtaatttgttgttggatgatgtatgcaatcgtttaccttgctcagatgaagccattgatcaaccccatcctgagcggagagtgagctctgtctcttcattaaacagaatgaaagctagacctgctgtaccattattcagtctgtgaactttctattcattttggcgcacctgatgaaataaataaactgccatgagtttttttgctactctgcactccagacattgaggaggctcgctgtgattagtgtatgcaattgtatgatatacgcaataataaatatctatgtgtcgctcctgtgcttttattggaatgttttttgtcacgtgattgtctgcttgaattggaattgggaacataaaacgatgtagcacgatttgctgtttcagtgggtgattttgacttttgagctaaacatttgttggtggcactggtacactgctaatgtctgctactttcatgattgaaagttgaaagtacacctgcaaaagatgtattgtttgattgacgtttaacgatgacttgatccacgttttccac

SEQ ID NO: 5161 - DNA, 672 bp, Setaria italica
cccccctgcttctctctctacccccctctcgcgtgtcgcgtctccttccccggccgcgcgatccagcgagcgagagagagaaagcagcagccgcgcgggaggagctctgctcgtcgaggccgccgacaaccatggggttctgggtgaccacgctcatcttcctcatcgccggcgtcgccgcctccctcttcacgctcctctgctgcaaccgcgggccgtccaccaacctattccatttgaccttggtgaccacggctgtaatttgttgttggatgatgtatgcgattgtttaccttgctcagatgaagcctttgatcaaccccatcttgagcggggagtgagctttctgttgaaaagagttaaatccgacatgctgtaccattattcagtctgtgaaccttttattcattttgggccgcctgaaataaagaaactgccatgaggttttttgctactctacctccagactatagcggaggcacgctgtgattagtgtacccaattgtatgataaacgcaataataaatatttatggtgtttttatctgaatgtctgggcatggatggatccaacattgtcaaatgttcatctgttggatttaaaacacaaatcggtcagacattatttgtggtatcggtgcgtgatgtagactttagaatctgcaatcttgtg

SEQ ID NO: 5162 - DNA, 571 bp, Setaria italica
caactccacctccatctcccccctgcttctctctctacccccctctcgcgtgtcgcgtctccttccccggccgcgcgatccagcgagcgagcgagagaaagcagcagccgcgcggaggagctctgctcgtcgaggccgccgacaaccatggggttctgggtgaccacgctcatcttcctcatcgccggcgtcgccgcctccctcttcacgctcctctgctgcaaccgcgggccgtccaccaacctattccatttgaccttggtgaccacggctataatttgttgttggatgatgtatgcgattgtttaccttgctcagatgaagcctttgatcaaccccatcttgagcggggagtgagctttctgttgaaaagagttaaatccgacatgctgtaccattattcagtctgtgaaccttttattcattttgggccgcctgaaataaagaaactgccatgaggttttttgctactctacctccagactatagcggaggcacgctgtgattagtgtacccaattgtatgataaacgcaataataaatatttatggtgtttttatctgaatgtctg

SEQ ID NO: 5163 - DNA, 1415 bp, Pennisetum glaucum
ggcggcgtccagcggaggtcaggtggtgaccggttccgttccggcgagcgggcgagccgcaggcggcgaagaggagggacgcggcgacctattcgagcaagccgggagcagtgcagagtcggaagcggcgatgtcgaagcggctggtgtcgcggctactggggatgttccagtcgcggacgcaggtgggcgtcgacaaggccggcaaccgctacttcacccgcgtcgaggaggtcgacggcgccatgaaggagaggcggtgggtggagttcaagggcgccgaccaggactcgaccaccgttccagtcgagtggatttgctggttgaatggccaaaggaagaaagctccaacgccagaagaattggctgagctggaggcgaggcgtgaacgtgtcaagcaaaacattgaacttctcaaaaagaaagaagaggaggaaagaaaggcaggtgtccgacacatcaagaaaattgggaaatctgaatctccaaatctccaaagttttgtgaagcagcagttccatggacctgaggaggtatctaggcctaaggatgcaactgatgcagaagattctataacagataatgagaggacttccgaaccaacaggaactggtgccacttttaaaccagggacttggcagccaccaacataaacggcaacctgaatttcagcagatggcgatgctgtacctgagcatttttcctttcagtttgttctggaagaatcagttacatgaatttcttgttggtcagcatttgtggggtagtaggttatcaggaaagccatgttgcccctgtatttttgccaaattctcctttgtaattttgatggaccattgtagtaactataataaactttgagcaaagttttgaatcatgcccctgttaggcttccttgtaaaaaaacaccataaatattattattgcgtttatcatacaattgggtacactaatcacagagtgcctccgcaatagtctggaggtagcaaaaaacctcatagcagtttctttatttcaggtagcccaaaatgaataaaaggttcacagactgaataatggtacagcatgtcggattaaattctttacagccaaaagctcactccccgctcaagatggggttgatcaaaggcttcatctgagcaaggtaaacgatcgcatacatcatccaacaacaaattacagccgtggtaaccaaggtcaaatggaataggttggtggacggcccgcggttgcagcagaggagcgtgaggagggaggcgacgacgccggcgaggaggaagatgagcgtggtcacccagaaccccatggtcgtcggcggcctcgacgagcagagctcctcccgcgcggctgctgctttctctctctcgctcgctcgctggatcgcgcggccggggaaggggacgcaacacgcgagag

SEQ ID NO: 5164 - DNA, 595 bp, Saccharum officinarum
cacctgccgcgtctccctccccgaccgagcgatccagcgagagggagcgagaagcagcagccgccggaggagctcgccgaggccgccgccgccgaatacgaccatggggttctgggtgacaacgctcatcttcctcctcgccggcgtcgccgcatccctcttcacgctcctctgctgcaaccggggccctccacaaacctattccatttgaccttgggactacagctgtaatttgttgttggatgatgtatgcaatcgttaccttgctcagatgaagccattgatcaatcccatcctgagcggagagtgagctctgcattaaaaagaatgaaagctagacctgctgtaccattattcagctgtgaactttctattcatgttggcccacctgatgaaataaataaactgccatgagtttttattttgctactcttcactccagacattgaggaggctcgctgtgattagtgtatgcaatggtatgatatacgcaatgataatatctatgtgccgctcctgtgcttttgtgcaacaaaaacaccacctacactctttcctaactctacccaattcttacaactctattgccgtccct

SEQ ID NO: 5165 - DNA, 730 bp, Panicum virgatum
ggcgatccagaagcacgtgacgtggctgacagcaactccgcctctctccatctctaggcctggcctgtcgcgtctccttccccgaccaggcgatctccagcgagcgagagaggaagcagcagccgcgcgtgaggggggctccgctcgtcgaggccgcgcccaccatggggttctgggtgtccacggtcatcttcctcctcgccggcgtcgtcgcctccctcttcacgctcctctgctgcaaccgcgggccatccaccaacctattccatttgaccttggtgactacggctgtaatttgttgttggatgatgtatgccatcgtttaccttgctcagatgaagcctttgatcaaccccatcctgagtggggagtgagctttctgttgaaaataattaaatccaacatgctgtaccattattcagtctgtgaaccttttattcattttggccacccagaaataaagaaactgccatgagttttttgctactctacctccaggttattgaggaggcacgctgtgattagtgtacccaattgtatgataacgcaataataatatttatggtgtttttatctgaatgtctgggcactgatctgtccaactttgtcgagtgtttctctgttagatttgaaacacaaaacatcaggcattatttgtggtttccgtgtacttagaatcatcacgaatcttgttaagagcaagaaataataatcttcatcttttgacgct

SEQ ID NO: 5166 - DNA, 534 bp, Panicum virgatum
tctccacccctctcggcctggcctgtcgcgtctccttccccgaccgggcgatctccagcgagcgagagagagagccagcagccgcgcgggaggagctctgctcgtcgaggccgcccaccatggggttctgggtgtccacggtcatcttcctcctcgccggcgtcgtcgcctccctcttcacgctcctctgctgcaaccgcgggtcatccaccaacctattccatttgaccttggtgactacggctgtaatttgttgttggatgatgtatgccattgtttaccttgctcagatgaagcctttgatcaaccccatcctgagcggggagtgagctttctgttgaaaataattaaatccaacatgctgtaccattattcagtatgtgaaccttttattcattttggccaccctgaaataaagaaactgccatgagttttttgctactctacctccaggttattgaggaggcacgctgtgattagtgtacccaattgtatgataaacgcaataataatatttatggtgtttttatctga

SEQ ID NO: 5167 - DNA, 625 bp, Oryza sativa
cacgtctgacccctgttcctcttcgctccgtctctccccaccccacctccgccccgagacgacgagacccagcgagcgatcccgagggaagaaagagatcgagagggaagggaagggagaggatcggagagctttccgccggccatggggttctgggtgaccacgctcatcttcctcctcgccggcttcgtcgcctccctcttctcgctgctctgctgcaaccgcgggccgtcgaccaacctattccatttgaccttggttattacagcaacggtttgctgttggatgatgtgggcaatcgtctatcttgcgcagctgaagccactgatcaaccctatcctaagcggcgagtgagctgtgttacaatttgaagtctgctcatgctgtatcactatttagttgaggatttctattcattttggcacgactgaaataaagaattgttgtgagattttggaacacttcctctagacactagaggatgcccactgtgattagtgtatgcaattatattatatacacaataatcggatcaatgaccttgtccattcaaacttccaaagtttacccaagataaatttctgcttccagctctagagagcaaaagtactttcttgaatgtttc

SEQ ID NO: 5168 - DNA, 612 bp, Oryza sativa
gacccctgttcctcttcgctccgtctctccccaccccacctccgccccgagacgacgagacccagcgagcgatcccgagggaagaaagagatcgagagggaagggaagggagaggatcggagagctttccgccggccatggggttctgggtgaccacgctcatcttcctcctcgccggcttcgtcgcctccctcttctcgctgctctgctgcaaccgcgggccgtcgaccaacctattccatttgaccttggttattacagcaacggtttgctgttggatgatgtgggcaatcgtctatcttgcgcagctgaagccactgatcaaccctatcctaagcggcgagtgagctgtgttacaatttgaagtctgctcatgctgtatcactatttagttgaggatttctattcattttggcacgactgaaataaagaattgttgtgagattttggaacacttcctctagacactagaggatgcccactgtgattagtgtatgcaattatattatatacacaataatcggatcaatgaccttgtccattcaaacttccaaagtttacccaagataaatttctgcttccagctctagagagcaaaagtactttcttgaa

SEQ ID NO: 5169 - DNA, 606 bp, Avena sativa
ccaagatccaatccaccacgagtcgacgactgagacgcgcacgcacgtccgtcacgtggcgctccccgcatcacatcaccctccttcctcttcctccccgcatctcgtcccccttcctccaccccggacccggcgacccgacccagcgatccggcgaagcccaagttcggagaaagggcgcccgccggacgtaaaccagcgatggggttcctggtgacctcggccatcttcctcctcgccggcatcgtcggctgcctcttctcgctcctctgctgcaaccgcggcccatccaccaacctattccatttgactctggttaccaccgctacagtttgttgttggatgatgtgggcaatcgtctatcttgcgcagatgaagcctctgatcaaccccatcctgagcggcgagtgagccgtgtgccaaagataatttaagatccagtcatgatgtatcattattcggttgagaacctctattcattttgccataacagaaataaagaaccactgtgagattttgctactccccttcagacatcgaggaggcatcctgtgattagttgtatgcaattgtattatatacacaataatgatgattctgtttgtt

SEQ ID NO: 5170 - DNA, 596 bp, Avena sativa
ccaagatccaatccaccacgagtcgacgactgagacgcgcacgcacgtccgtcacgtggcgctccccgcatcacatcaccctccttcctcttcctccccgcatctcgtcccccttcctccaccccggacccggcgacccgcccagcgatccggcgaagcccaagttcggagaaagggcgcccgccggacgtaaaccagcgatggggttcctggtgacctccgccatcttcctcctcgccggcatcgtcggctgcctcttctcgctcctctgctgcaaccgcggcccatccaccaacctattccatttgactctggttaccaccgctacagtttgttgttggatgatgtgggcaatcgtctatcttgcgcagatgaagcctctgatcaaccccatcctgagcggcgagtgagccgtgtgccaaagataatttaagatccagtcatgatgtatcattattcggttgagaacctctattcattttgccataacagaaataaagaaccactgtgagattttgctactccccttcagacatcgaggaggcatcctgtgattagttgtatgcaattgtattatatacacaataatgatgatt

SEQ ID NO: 5171 - DNA, 495 bp, Lolium multiflorum
cgacccacccagcgatccggcgaacccgaacctcccgcggagagcatccccgtccggccagcgagcgatggggttcctggtgacctcgggcatcttcctcctggccggcatcatcggctgcctcttctcgctcctctgctgcaaccgcggaccctccaccaacctattccatttgactctggttattaccgctacagtttgctgttggatgatgtgggcaatcgtctatcttgcgcagatgaagcctctgatcaaccccatcctgagtggcgagtgagccgtgcgctaaagataatttaagatgcagccatgatgtattattgttcggttgagaacttctattcattttgtgaaactgaaataaagaaccactgtgagattttgctactcttcctcgaggaggaatgctgtgattagtgtatgcaattgtattatatacacaataataatggttctatttatccaaaaaaaaagtacctcggccgcgaccacgct

SEQ ID NO: 5172 - DNA, 628 bp, Festuca arundinacea
  misc_feature (45)..(45): n is a, c, g, or t
ggcacgaggcgttccctcctccacccggacccggcgacccgcccngcgatccggcgaagccgaagctcccgcggagagcatcccccgtccagccagccagcgatggggttcctggtgacctccggcatcttcctcctggccggcatcatcggctgcctcttctcgctcctctgctgcaaccgcggcccctccaccaacctattccatttgactctggttattaccgctacagtttgttgttggatgatgtgggcaatcgtctatcttgcgcagatgaagcctctgatcaaccccatcctgagcggcgagtgagccgtgcgctaaagataatttaagatccagccatgatgtattattgttcggttgagaacttctattcattttgcgaaactgaaataaagaaccactgtgagattttgctactcttcctcgaggaggaatgctgtgattagtgtatgcaattgtattatatacacaataataatgattctatctatccatgccacccctttgttgttagttggatcttggatcactcattgcgtagtgccttgtgattttaaatgtacttgaggtagttgtcttttgaattggaacacaaagtctgcgtgaaatagtttggtgtttc

SEQ ID NO: 5173 - DNA, 536 bp, Allium cepa
ctaaattcctattttgttccctcagttccccagatcaaatctgaaatcaaaacaccaaaaatttctctctccgaacctatatcatcaagaatattggtcgtcggtttaatttctccaatcaaaagaataaattaatgggattttggagtacgacactgatattcatacttgccggcgtcgtcgcttgcctctccgctctcctctgctgcaatcgtggcccctctacgaatttgttccatctgactctgctgattaccgcaacagtttgctgctggatgatgtgggcaattgtatatcttgcacagatgaatccactaattgttccgatactcagcgaaggagaatgatatagctcttgatatatattttaattgaaattcactttgcccggcaacaaattgtactgtgttcatcataattcatttatgtatctaatttcttgactaagtgaatgttataacattctgttagtattgctgccaaggattttttttattgcgtctgctgcttatttcttcttcatgccttttaccttg

SEQ ID NO: 5174 - protein, 223 aa, Triticum aestivum
MDARPRRASSSPAAATAALSLLLLFPMFLGGQASAYGDDSGAGSMTALQKHAAFFDGDKDGVVTFSETYAAFRALGFGYAASTLSATFINGVLGPQTRPENDTARMSIYIENIHKGIHGSDSGAYDSQGRFVPEKFEAAFAKHAKTVPDALTSAEVDELITANREPSDYAGWAGASAEWKLLYSIGKDKDGLLRKDAARGVYDGSLFARVVQERRTSIGETQA

SEQ ID NO: 5175 - protein, 228 aa, Triticum aestivum
MDARPRRASSSPAAATATAAAALSLLLLFPMFLGGQASGYGDDSGAGGMTALQKHAAFFDRDKDGVVTFSETYAAFRALGFGFASSTLSATFINGVLGPQTRPENDTARMSIYIENIHKGIHGSDSGAYDSQGRFVPDKFDAAFAKHGKTVPDALTSAEVDELITANRQPSDYAGWAGASAEWKLLYSIGKDEDGLLRKDAARGVYDGSLFARVVQERRASSLEETQA

SEQ ID NO: 5176 - protein, 224 aa, Secale cereale
MDARPRRASSSPPPAAAAALSLLLLFPMFLGSQASGYGDDSGAGGMTALQKHAAFFDADKDGVVTFSETYAAFRALGFGYGASTLSATFINGVLGPQTRPENDTARMSIYIENIHKGIHGSDSGAYDSQGRFVPEKFEAVFARHAKTVPDALTSGEVDELITANRQPSDYAGWAGASAEWKLLYSIGKDKDGLLRKDAARGVYDGSLFARVVHERRAAREETQA

SEQ ID NO: 5177 - protein, 225 aa, Leymus cinereus x Leymus triticoides
MDARPRQASSSPPSAVAGLFLLLFPMFLGSQASGYGDDSGAGGMTALQKHAAFFDGDKDGVVTFSETYAAFRALGFGYAASTLSATFINGVLGPQTRPGNDTSRLSIYIENIHKGIHGSDSGAYDSQGRFVPDKLEAVFARHGKTVPDALTSAEVDELITANRQPSDYAGWAGASAEWKMLYSIGKDKDGLLRKDAARGVYDGSLFARVVQERRASQEPEETTQA

SEQ ID NO: 5178 - protein, 61 aa, Hordeum vulgare
NSQKRAWLMKSFEMDARPRLPSSSPAAATAAFSLLFLFLMLQGSQALAHGNYSVACGMTAL

SEQ ID NO: 5179 - protein, 775 aa, Triticum aestivum
MIPARHMPSSMIGRSSGGAPYGSSSALSLGQPNLLDGSNQHLLPHHLLEQIPARAAESGDNNGSVGGGVGMIRGRDSMDPLGDEFESRSGSENVDGDAVDNAEQEQDPNQRPRKKRYHRHTQHQIQEMEAFFKECPHPDDKQRKELSRELGLEPLQVKFWFQNKRTQMKNQHERHENSQLRADNDKLRAENMRYKEALSSASCPNCGGPAALGEMSFDEHHLRVENARLRDEIDRISAIAAKYVGKPMVPFPVLSSPLAAAPGASAYDVFAGAASVLQAPPDDKQQGVVVELAVAAMEELLRMARLDDPLWATTVDQALALDEEEYARMFIDPRGGLGPKQYGLVSEASRDAAVVIMTPASLVEILMDVNQYAAVFSSIVSRAATLEVLSTGVAGCYDGALQVMSVEFQVPSPLVPTRESYFVRYCKRNADGAWAVVDVSLDGLQGVKCRRRPSGCLIQEAPNGYSKVTWVEHVEVDDRSVHNIYKPLVGSGLAFGARRWVGVLGRQCERLASAMASNIPTSDIGVITSSEGRKSMLKLAERMVASFCGGVTASVAHQWTTLSGSGAEDVRVMTRKSVDDPGRPPGIVLNAATSFWLPVPPKRVFDFLRDETSRSEWDILSNGGIVQEMAHIANGRDHGNCVSLLRVNSTNSNQSNMLILQESCTDASGSYVIYAPVDVVAMNVVLNGGDPDYVALLPSGFAILPDGPAGTMHAAAGATGTGGSLLTVAFQILVDSVPTAKLSLGSVATVNSLIACTVERIKTAVISNGGASPPQ

SEQ ID NO: 5180 - protein, 774 aa, Secale cereale
MIPARHMPSSMMGRSSGGAPYGSSSALSLGQPNLLDGSNQHLLPHHLLEQIPARAAESGDNNGSGGGVGMIRGRDSMDPLGDEFESRSGSENVDGDAVDNAEQDQDPNQRPRKKRYHRHTQHQIQEMEAFFKECPHPDDKQRKELSRELGLEPLQVKFWFQNKRTQMKNQHERHENSQLRADNDKLRAENMRYKEALSSASCPNCGGPAALGEMSFDEHHLRVENARLRDEIDRISAIAAKYVGKPMVPFPVLSSPLAAAPGASAYDVFAGAASVLQAPPDDKQQGVVVELAVAAMEELLRMARLDDPLWATTVDQTLALDEEEYARMFVDPRGGLGPKQYGLVSEASRDAAVVIMTPASLVEILMDVNQYSAVFSSIVSRAATLDVLSTGVAGCYDGALQVMSVEFQVPSPLVPTRESYFVRYCKRNADGAWAVVDVSLDGLQGVKCRRRPSGCLIQEAPNGYSKVTWVEHVEVDDRSVHNIYKPLVGSGLAFGARRWVGVLGRQCERLASAMASNIPTSDIGVITSSEGRKSMLKLAERMVASFCGGVTASVAHQWTTLSGSGAEDVRVMTRKSVDDPGRPPGIVLNAATSFWLPVPPKRVFDFLRDETSRSEWDILSNGGIVQEMAHIANGRDHGNCVSLLRVNSTNSNQSNMLILQESCTDASGSYVIYAPVDVVAMNVVLNGGDPDYVALLPSGFAILPDGPAGTMHSAAGATVTGGSLLTVAFQILVDSVPTAKLSLGSVATVNSLIACTVERIKTAVISNGGASPPQ

SEQ ID NO: 5181 - protein, 786 aa, Brachypodium distachyon
MIPVRHMPSSMIGRSSAAYGSSSSALSLGQPNLLDSNHQQLHHHQALLNHQIPAPAMAESSDNSGRRSMVRRRSEPLGEDFESRSGSENVDGDGVEDELQQQADPNKRPRKQNRYHRHTQHQIQEMEAFYKECQHPDDKQRKELSRELGLEPLQVKFWFQNKRTQTKNQQERHENSQLRGENDKLRAENMRYKEALSSASCPSCGGPAALGEMSFDEHHLRLENARLRDEIDRISAIAAKYVGKPAVPFPVLSNPLAAVGAYGHHHLGADMFGELQQPMRPTGGAGDQNKGVVVELAVAAMEELLRMTRLNEPLWAGPGVAGPMETLNEEEYARMFGGPRGGGLGPKQYGQLVSEASRESAVVILTPANLVEILMDVNQYAAVFSSIVSRAATLEVLSTGVAGCYDGALQVMSVEFQVPSPLVPTRESYFVRYCKQNSDGTWAVVDVSLDTLQGIKCRRRPSGCLIQEAPNGYSKVTWVEHVEVDDRSVHNIYKLLVNSGLAFGARRWVGALGRQCERLASVMASNIPNSDIGVITSSEGKKSMLKLAERMVASFCGGVTASVAHQWTRLSGSGAEDVRVMTRQSVDDPGRPPGIVLNAATSFWLPVPPKRVFDFLRDETSRSQWDILSNGGVVQEMAHIANGRDHGNCVSLLRVNSTNSNQSNMLILQESCTDASGSYVIYAPVDIVAMNVVLNGGDPDYVALLPSGFAILPDGPAGNIHTGGGPSVSDGGVGSGGSLLTVAFQILVDSVPTAKLSLGSVATVNSLIACTVERIKAAVSGESSPQ

SEQ ID NO: 5182 - protein, 780 aa, Setaria italica
MIPARHMPSMMIGRNSAAAAYGSSSALSLGQPNLLDNPQLQQALQQQHLLDQIPATTAESGDDMMRGGRGSDPLGDEFESKSGSENVDGVSVDDQDPNQRPSKKKRYHRHTQHQIQEMEAFFKECPHPDDKQRKELSRELGLEPLQVKFWFQNKRTQMKNQHERQENSQLRADNEKLRAENMRYKEALSSASCPNCGGPAALGEMSFDEHHLRIENARLREEIDRISAIAAKYVGKPMVSFPVLSSPLAAARASTLDIGVGAGAYGATDIFGGVTAGAGELLRGAVQSDADKPMIVELAVTAMEELVRMAQLDEPLWNAPGLDGSSETLNEEEYSRMFPRGLGPKQYGLKSEASRDSSVVIMTHANLVEILMDVNQYATVFSSMVSRAATLEVLSTGVAGNYNGALQVMSVEFQVPSPLVPTRESYFVRYCKQNADGTWAVVDVSLDSLRPGSVLKCRRRPSGCLIQEMPNGYSKVTWVEHVEVDDRSVHNIYKLLVNSGLAFGARRWVGTLDRQCERLASVMASNIPTSDIGVITSTEGRKSMLKLAERMVMSFCGGVTASAAHQWTTLSGSGAEDVRVMTRKSVDDPGRPPGIVLNAATSFWLPVPPKRVFDFLRDESSRSEWDILSNGGVVQEMAHIANGRDHGNCVSLLRVNSTNSNQSNMLILQESCTDASGSYVIYAPVDVVAMNVVLNGGDPDYVALLPSGFAILPDGPAGGNMQGDGGVGSGGSLLTVAFQILVDSVPTAKLSLGSVATVNSLIACTVERIKAAVSGESNPQ

SEQ ID NO: 5183 - protein, 783 aa, Oryza sativa
MIPARHMPSMIGRNGAAYGSSSALSLSQPNLLDNHQFQQAFQHQQQQHHLLDQIPATTAESGDNMIRSRASDPLGGDEFESKSGSENVDGVSVDDQDPNQRPRKKRYHRHTQHQIQEMEAFFKECPHPDDKQRKELSRELGLEPLQVKFWFQNKRTQMKNQHERHENSQLRSDNEKLRAENMRYKEALSSASCPNCGGPAALGEMSFDEHHLRIENARLREEIDRISAIAAKYVGKPMVPFPVLSNPMAAAASRAPLDLPVAPYGVPGDMFGGGGAGELLRGVQSEVDKPMIVELAVAAMEELVRMAQLDEPLWSVAPPLDATAAAMETLSEEEYARMFPRGLGPKQYGLRSEASRDSAVVIMTHANLVEILMDANQYAAVFSNIVSRAITLEVLSTGVAGNYNGALQVMSVEFQVPSPLVPTRESYFVRYCKQNADGTWAVVDVSLDSLRPSPVLKCRRRPSGCLIQEMPNGYSKVTWVEHVEVDDRSVHNIYKLLVNSGLAFGARRWVGTLDRQCERLASVMASNIPTSDIGVITSSEGRKSMLKLAERMVVSFCGGVTASVAHQWTTLSGSGAEDVRVMTRKSVDDPGRPPGIVLNAATSFWLPVPPKRVFDFLRDESSRSEWDILSNGGIVQEMAHIANGRDQGNCVSLLRVNSSNSNQSNMLILQESCTDASGSYVIYAPVDVVAMNVVLNGGDPDYVALLPSGFAILPDGPAHDGGDGDGGVGVGSGGSLLTVAFQILVDSVPTAKLSLGSVATVNSLIACTVERIKAAVSGESNPQ

SEQ ID NO: 5184 - protein, 165 aa, Unknown
  Sequence found in Organisms: Secale cereale, Triticum aestivum
MAAGKRTIGLAMDYSPSSKAATRWVVENLVKAGDRIILIHVLPKGADASHKGLWKSTGSPLIPLLEFMEMNVQARYGVNPDKEVLEILQAESKSKQVEILAKIYWGDAREKLCEAVDDLKVDSVVLGCRGLGPLKRALLGSVSNYVVNNATCPVTVVRGPNGSLA

SEQ ID NO: 5185 - protein, 165 aa, Triticum aestivum
MAAGKRTIGLAMDYSPSSKAAMRWVVENLVKAGDRIILIHVLPKGADASHKGLWKSTGSPLIPLLEFMEMNVQARYGVNPDKEVLEILQAESKSKQVEILAKIYWGDAREKLCEAVDDLKVDSVVLGCRGLGPLKRALLGSVSNYVVNNATCPVTVVRGPNGSLA

SEQ ID NO: 5186 - protein, 166 aa, Brachypodium distachyon
MAAEKHTIGLAMDYSPSSKAAAKWAFDNLVKAGDRIILIHVLPKGTDASHKGLWKSTGSPLIPLLEFMEMNVQARYGVNPDKEVLEILQAESKSKQVEVLAKIYWGDAREKLCEAVDDLKVDSVVLGCRGLGPLKRALLGSVSNYVVNNATCPVTVVRGPTGSNAA

SEQ ID NO: 5187 - protein, 165 aa, Oryza sativa
MAAEKRTIGLGMDYSPSSKAAAKWAVDNLVKAGDRIILVHVLPKGADASHKELWKSTGSPLIPLLEFMEMNVQARYGINPDKEVLEILQAESKSKQVEVLAKVYWGDAREKLCEAVDDLKVNTFVLGCRGLGPLKRALLGSVSNYVVNNATCPVTVVRAPTVSNA

SEQ ID NO: 5188 - protein, 165 aa, Sorghum bicolor
MAAEKRTIGMGMDYSPSSKAAARWAVDNLLKAGDRIILVHVLPKGADASHKELWKSTGSPLIPLPEFMEMNVQARYGLNPDKEILEILQAASKSKQVEVLAKIYWGDAREKLCEAVDDLKVNSFVLGCRGLGPLKRALLGSVSNYVVNNATCPVTVVRGPTGSSA

SEQ ID NO: 5189 - protein, 162 aa, Panicum virgatum
MAAGKRTIGMGMDYSPSSKAAARWAVDNLVKAGDRIILVHVLSKGADASHKELWKSTGSPLIPLPEFMEMNVQARFGLNPDKEVLEILKAASKAKQVEVLAKIYWGDAREKLCEAVDDLKADSFVLGCRGLGPLKRALLGSVSNYVVNNATCPVTVVRGPTM

SEQ ID NO: 5190 - protein, 165 aa, Setaria italica
MATGKRTIGMGMDYSPSSKASARWAIDNLLKAGDRIILVHVIPKGADASHKELWKSTGSPLIPLPEFMEMNVQARYGLVPDKEILEILQAASKAKQVEVLAKIYWGDAREKLCEAVDDLKVNSFVLGCRGLGPLKRALLGSVSNYVVNNATCPVTVVRGPTASSA

SEQ ID NO: 5191 - protein, 165 aa, Pennisetum glaucum
MAAGNRTVGMGMDYSPSSKAAVRWAVDNLLKAGDRIILVHVIPKNADASHKELWKSTGSPLIPLPEFMEMNVQARYGLVPDKEILEILQAASKAKQVEVLAKIYWGDAREKLCEAVDDLKLNSFVLGCRGLGPLKRALLGSVSNYVVNNATCPVTVVRGPTASSA

SEQ ID NO: 5192 - protein, 165 aa, Zea mays
MAAEKRTIGMGMDYSPSSKAAARWAVDNLIKAGDRLVLVHVLPKGVDSSHKELWKTTGSPLIPLSEFMEMNLQARYGLNPDKETLEILRAVSKSKQVEVLAKVYWGDAREKLCEAVDDLKVDSFVLGCRGLGPLKRALLGSVSNYVVNNATCPVTVVRGPTGLSA

SEQ ID NO: 5193 - protein, 441 aa, Leymus cinereus x Leymus triticoides
  misc_feature (107)..(107): Xaa can be any naturally occurring amino acid
MAEHDLTASVAAWMDPHLVLPVLEFLQERGVYADEEILRGKIRLLGGTNMVDYAMDIHKSLHGTDDVPADMVARRSEVVERLRALQEAVAPIVAFLSSPQLVQELHXDKQYNLHMLQERHQIGPDQIEALYQYAKFQYECGMYSDAADFLSQYRALCTNSERSLSALWGKLAAEILMQNWDVAQEELNRLKEMIDSSSFTSSPVNQLHSRIWLMHWSLFIFFNHENGRNGIIDLFFQDRYLNAIQTNAPHLLRYLAAAVVVNKRRRNMLKELIKVIQQEQNSYKDPIIEFLECLYVKYDFDGAQQKLVECEQVILNDPFLGKRVEERNGIAVPLRDEFLENARLFIFETYCRIHRCIDIGVLAEKMNMTYDEAELWIMNMVKSSKLDAKIDSVTGTLIMTTNRVDVHEQIIESMKNLNARTYMLAKSVVDPGHAAAQQAAR

SEQ ID NO: 5194 - protein, 441 aa, Triticum aestivum
MAEHDLTASVAAWMDPHLVLPVLEFLQERGVYADEEILRGKIRLLGGTNMVDYAMDIHKSLHGTDDVPADMVARRSEVVERLRALQEAVAPIVAFLSSPQLVQELHADKQYNLHMLQERHQIGPDQIEALYQYAKFQYECGMYSDAADFLSQYRALCTNSERSLSALWGKLAAEILMQNWDVAQEELNRLKEMIDSSSFTSSPVNQLHSRIWLMHWSLFIFFNHENGRNGIIDLFFQDRYLNAIQTNAPHLLRYLAAAVVVNKRRRNMLKELIKVIQQEQNSYKDPIIEFLECLYVKYDFDGAQQKLVECEQVILNDPFLGKRVEERNGIAVPLRDEFLENARLFIFETYCRIHRCIDIGVLAEKLNMTYDEAELWIMNMVKSSKLDAKIDSVTGTLIMTTNRVDVHEQIIESMKNLNARTYMLAKSVVDPGHAAAQQAAR

SEQ ID NO: 5195 - protein, 441 aa, Secale cereale
MAEHDLTASVAAWMDPHLVLPVLEFLQERGVYADEEILRGKIRLLGGTNMVDYAMDIHKSLHGTDDVPADMVARRSEVVERLRALQEAVAPIVAFLSSPQLVQELHADKQYNLHMLQERHQIGPDQIEALYQYAKFQYECGMYSDAADFLSQYRALCTNSERSLSALWGKLAAEILMQNWDVAQEELNRLKEMIDSSSFTSSPVNQLHSRIWLMHWSLFIFFNHENGRNGIIDLFFQDRYLNAIQTNAPHLLRYLAAAVVVNKRRRNMLKELIKVIQQEQNSYKDPIIEFLECLYVKYDFDGAQQKLVECEQVILNDPFLGKRVEERNGIAVPMRDEFLENARLFIFETYCRIHRCIDIGVLAEKLNMTYDEAELWIMNMVKSSKLDAKIDSVTGTLIMTTNRVDVHEQIIESMKNLNARTYMLAKSVVDPGHAAAQQAAR

SEQ ID NO: 5196 - protein, 440 aa, Brachypodium distachyon
MAEHDLTARMAAQMDCHLVFPLLEFLQERQLYADDQILEAKIRLLSGTNMVDYAMDIHKSLHGTDDVPADMVARRSEVVARLRTLDEAAAPLVGFLSNPQLVQELRPDKQYNIHMLQERYQIGPDQIEALYQYAKFQFECGNYSGAADFLYQYRALCTNSERSLSALWGKLAAEILMQNWDVAQEELNRLKELIDSKNFSSPINQLHSRIWLMHWSLFIFFNHENGRNGIIDLFFQDRYLNAIQTNAPHLLRYLAAAVVVNKRRRNMLKELIKVIQQEQQCYKDPITEFLECLYVNYDFDGAQQKLIECEQVILNDPFLGKRIEEGNFITVPLRDEFLENARLFIFETYCRIHRCIDIGMLAEKMNMTYDEAELWIMNLVKSSKLDAKIDSVTGTLIMTTNHVNVHEQIIENMKNLNARTYMLAKSLVDPGHAAAQQAAR

SEQ ID NO: 5197 - protein, 436 aa, Avena sativa
MAKYDLTARLIAQMDCHLALPMLEYLQERKVYPDEQILEGKISLLSGTNMVDYAMDIHKSLHGTEDVPADMVARRSEVVERLRSLQEAVGPIVAFLSNPQLVQELRADKQYNIHILQERHRIGPEQIEALYQYAKFQFECGMYSEAADFLSQYRALCTDSERSLSALWGKLAAEILMQNWDVAQEELNRLKEIIDSNKFSSPISQLHSRIWLMHWSLFIFFNHENGKNGIIDLFFQERYLNAIQTNAPHLLRYLAAAVVVNKRRRNMLKELIKVIQQEQQSYKDPIIELLECLYVKYDFDGAQQKLIECEQVILNDPFLGKRIEEGNFIRVPLRDEFLENARLFIFENYCRIHRCIDIGMLAEKMNMTYDEAEPWIMNLIKSSQLDAKIDSVTGTLVMATNHVNVHEKIIESMKNLNARTYMLAKSLVDPGHAAAA

SEQ ID NO: 5198 - protein, 439 aa, Panicum virgatum
MAEHDLTALLAAQMDRHLVFPLLEFLQERQLYSEPEILEAKIRLLSGTNMVDYAMDIHKSLHGTDDVPEDMVRRRAEVVSRLRSLEEAAAPLVTFLQNPQLVQELRPDKQYNIHMLQDRYQIGPDQIEALYQYAKFQFECGNYSGAADYLYQYRALCTNSERSVSALWGKLAAEILMQNWDVALEELNRLKEIIDSKNFSSPLNQLQNRIWLMHWALFIFFNHENGRNGIIDLFFQDRYLNAIQTNAHHLLRYLATAVVVNKRRRNMLKELIKVIQQEQHSYKDPITEFLECLYVNYDFDGAQQKLMECEQVILNDPFLGKRIEEGNFVTVPLRDEFLENARLFIFETYCRIHRCIDIGMLAQKLNMSYDEAELWIMNLVRNSKLDARIDSVSGTLIMTTNHVNVHEQIIESLKGLNMRTYMLAKNIVEPAQAAQQAAR

SEQ ID NO: 5199 - protein, 438 aa, Panicum virgatum
MAEHDLTALLAAQMDRHLVFPLLEFLQERQLYSEPEILEAKIRLLSGTNMVDYAMDIHKSLHGTDDVPEDMVRRRAEVVSRLRSLEEAAAPLVTFLQNPQLVQELRPDKQYNIHMLQDRYQIGPDQIEALYQYAKFQFECGNYSGAADYLYQYRALCTNSERSVSALWGKLAAEILMQNWDVALEELNRLKEIIDSKNFSSPLNQLQNRIWLMHWALFIFFNHENGRNGIIDLFFQDRYLNAIQTNAHHLLRYLATAVVVNKRRRNMLKELIKVIQQEQHSYKDPITEFLECLYVNYDFDGAQQKLMECEQVILNDPFLGKRIEGNFVTVPLRDEFLENARLFIFETYCRIHRCIDISMLAQKLNMSYDEAELWIMNLVRSSKLDARIDSVSGTLIMTTNHVNVHEQIIESLKGLNMRTYMLAKNIVEPAQAAQQAAR

SEQ ID NO: 5200 - protein, 439 aa, Sorghum bicolor
MAEHDLTALMAAQLDRHLVFPLLEFLQERQLYSEPEILEAKIRLLSGTNMVDYAMDIHKSLHGTDDVPEDMVKRRAEVVSRLRSLEEAAAPLVAFLQNPQLVQELRPDKQYNIHMLQERYQIGPDQIEALYQYAKFQFECGNYSGAADYLYQYRALCTNSERSVSALWGKLAAEILMQNWDVALEELNRLKEIIDSKNFSSPLNQLQNRIWLMHWALFIFFNHENGRNGIIDLFFQDRYLNAIQTNAHHLLRYLATAVVVNKRRRNMLKELIKVIQQEQHTYKDPITEFLECLYVNYDFDGAQQKLMECEQVILNDPFLGKRIEEGNFVTVPLRDEFLENARLFIFETYCRIHRCIDISMLSQKLNMSYDEAELWIMNLVRSSKLDARIDSVSGTLIMTTNHVNVHEQIIENLKGLNMRTYMLAKNIVEPAQAAQQATR

SEQ ID NO: 5201 - protein, 439 aa, Pennisetum glaucum
MAEHDLTALLAAQLDRHLVFPLLEFLQERQLYSEPEILEAKIRLLSGTNMVDYAMDIHKSLHGTDDVPEDMVRRRAEVVSRLRSLEEAAAPLVTFLQNPQLVQELRPDKQYNIHMLQDRYQIGPDQIEALYQYAKFQFECGNYSGAADYLYQYRALCTNSERSVSALWGKLAAEILMQNWDVALEELNRLKEIIDSKSFSSPLNQLQNRIWLMHWALFIFFNHENGRNGIIDLLFQDRYLNAIQTNAHHLLRYLATAVVVNKRRRNMLKELIKVIQQEQHSYKDPITEFLECLYVNYDFDGAQQKLMECEQVILNDPFLGKRIEEGNFVTVPLRDEFLENARLFIFETYCRIHRCIDISMLSQKLNMSYDEAELWIMNLVRSSKLDARIDSVSGTLIMTTNQVNVHEQIIESLKGLNMRTYMLAKNLVEPAQAAQQATR

SEQ ID NO: 5202 - protein, 439 aa, Setaria italica
MAEHDLTALLAAQMDRHLVFPLLEFLQERQFYSEPEILEAKIRLLSGTNMVDYAMDIHKSLHGTDDVPEDMVRRRTEVVSRLRSLEEAAAPLVTFLQNPQLVQELRPDKQYNIHMLQDRYQIGPDQIEALYQYAKFQFECGNYSGAADYLYQYRALCTNSERSVSALWGKLAAEILMQNWDVALEELNRLKEIIDSKNFSSPLNQLQNRIWLMHWALFIFFNHENGRNGIIDLFFQDRYLNAIQTNAHHLLRYLATAVVVNKRRRNMLKELIKVIQQEQHSYKDPITEFLECLYVNYDFDGAQLKLMECEQVILNDPFLGKRIEEGNFVTVPLRDEFLENARLFIFETYCRIHRCIDISMLSQKLNMSYDEAELWIMNLVRSSKLDARIDSVSGTLIMTTNHVNVHEQIIESLKGLNMRTYMLAKNIVEPAQATQQATR

SEQ ID NO: 5203 - protein, 439 aa, Saccharum officinarum
MAEHDLTALMAAQLDRHLVFPLLEFLQERQLYSEAEILEAKIRLLSGTNMVDYAMDIHKSLHGTDDVPEDMVKRRAEVVSRLRSLEEAAAPLVAFLQNPQLVQELRPDKQYNIHMLQERYQIGPEEIEALYQYAKFQFECGNYSGAADYLYQYRALCTNSERSVSALWGKLAAEILMQNWDVALEELNRLKEIIDSKNFSSPLNQLQNRIWLMHWALFIFFNHENGRNGIIDLFFQDRYLNAIQTNAHHLLRYLATAVVVNKRRRNMLKELIKVIQQEQHSYKDPITEFLECLYVNYDFDGAQQKLMECEQVILNDPFLGKRIEEGNFVTVPLRDEFLENARLFIFETYCRIHRCIDISMLSQKLNMSYDEAELWIMNLVRSSKLDARIDSVSGTLIMTTNHVNVHEQIIENLKGLNMRTYMLAKNIVEPAQAAQQATR

SEQ ID NO: 5204 - protein, 163 aa, Setaria italica
MAEHDLTALLAAQMDRHLVFPLLEFLQERQFYRSRRSWRPRSASSAAPTWSTTPWTSTSPSTAPTTSPRTWSGAAPRSSPGSGRSRRPPPRSSPSFRTRSSCRSSGPTSSTTSTCSRTGTRLVLIRLRLCISMLNFSLSVVTTRGLLTTCTSIVLCAPTVRGV

SEQ ID NO: 5205 - protein, 436 aa, Zea mays
MADHDLTALMAAQLDRHLVFPLLEFLQERQLYSRPEILEAKIRLLSGTNMVDYAMDIHKSLHGTDDVPEDMVKRRSEVVSRLRSLDEAAAPLVAFLQNPQLVQELRPDKQYNIHMLQERYQIGPDQIEALYQYAKFQFECGNYSWAAEYLYQYRALCTDTERSVSALWGKLAAEILMQNWDVALEEFNRLKEIIDSKNFSSPLNQLQNRIWLMHWALFIFFNHENGRNGIIDLFFQDRYLNAIQTNAHHLLRYLATAVVVNKRRRNMLKELIKVIQQEQHSYKDPITEFLQCLYVNYDFDGAQQKLVECEQVILNDPFLGKRVEEGNFVTVPLRAEFLENARLFIFETYCRIHRCIDISMLAQRLNMSYDEAELWIMNLVRSSKLDARIDSVSGTLIMTTNHINVHEQIIESMKGLNMRTYMLAKNIVEPAQQAAR

SEQ ID NO: 5206 - protein, 439 aa, Oryza sativa
MAEHDLTARMAGQMDCHLVFPLLEFLQERALYANKEILEAKLRLLSGTNMVDYAMDIHKSLHDTDEVPDDMVRRRTDVVSRLRALDEATAPIVSFLQNQQLVQELRPDKQYNLHMLQDRFQIGPEQIETLYQYAKFQFDCGNYSDAAVYLYQYRALCTNSERSLSALWGKLAAEILMQNWDVALDELNRLKEIIDSKNFSSPLNQLQNRIWLMHWSIFIFFNHENGRNGIIDLFFQDRYLNAIQTNAPHLLRYLATAVVVNKRRRNMLKELIKVIQQEQHSYKDPITEFLECLYVNYDFDGAQQKLIECEQVILNDPFLGKRIEEGNFVTVPLRDEFLENARLFIFETYCRIHRCIDIGMLSQKLNMSYDEAELWIMNLVRNSKLDAKIDSVSGTLIMTTNHVNIHEQVIESLKNLNMRTFLLAKNIVEPAQAAQQAAR

SEQ ID NO: 5207 - protein, 439 aa, Oryza sativa
MAEHDLTARMAGQMDCHLVFPLLEFLQERALYANKEILEAKLRLLSGTNMVDYAMDIHKSLHDTDEVPDDMVRRRTDVVSRLRALDEATAPIVSFLQNQQLVQELRPDKQYNLHMLQDRFQIGPEQIETLYQFAKFQFDCGNYSDAAVYLYQYRALCTNSERSLSALWGKLAAEILMQNWDVALDELNRLKEIIDSKNFSSPLNQLQNRIWLMHWSIFIFFNHENGRNGIIDLFFQDRYLNAIQTNAPHLLRYLATAVVVNKRRRNMLKELIKVIQQEQHSYKDPITEFLECLYVNYDFDGAQQKLIECEQVILNDPFLGKRIEEGNFVTVPLRDEFLENARLFIFETYCRIHRCIDIGMLSQKLNMSYDEAELWIMNLVRNSKLDAKIDSVSGTLIMTTNHVNIHEQVIESLKNLNMRTFLLAKNIVEPAQAAQQAAR

SEQ ID NO: 5208 - protein, 436 aa, Zea mays
MSEHDLTALMAAQLDRHLVFPLLEFLQERQLYSESEILEAKIRLLSGTNMVDYAMDIHKSLYGTDDVPEDMVKRRAEVVSRLRSLEEAAAPLVAFLQNPQLVQEFRPDKQYNIHMLQERYQIGPDQIEALYQYAKFQFECGNYSGAADYLYQYRALCTNSERNVSALWGKLAAEILMQNWDVALEELNRLKEIIDSKNFSSPLNQLQNRIWLMHWALFIFFNHENGRNGIIDLFFQDRYLNAIQTNAHHLIRYLATAVVVNKRRRNMLKELIKVIQQEHHSYKDPVTEFLECLYVNYDFDGAQQKLIECEQVILNDPFLGKRIEEGNFVSVPLRDEFLENARLFIFETYCRIHRCIDISMLAQKLNMSYDEAELWIMNLVRSSKLDARIDSVSGTLIMTTNHVNVHEQIVESLKGLNMRTYMLAKNIVEPAQQATR

SEQ ID NO: 5209 - protein, 175 aa, Triticum aestivum
MSGWFGGKTDAKDEEAAKTGPSVQDRAIEAKDQTISFIGEKSEAVTKAASDTADAAMKMGGDAMGKASETGQAITDRAIESKDQTFGFFGEKTEAAKKMAVDTGDAAKQKSAEAAKCVEETAAKFTGEPAAPKEPTGNMFQQAGGQVMGAATGARDAVMNTLGMGGDKADTGTAK

SEQ ID NO: 5210 - protein, 175 aa, Triticum aestivum
MSGWFGGKTDAKADEAAKTGPSVQDRAIEAKDQTISFIGEKSEAVTKAASDTADAAMKMGSDAMGKASETGQAITDRAIESKDQTFGFFGEKTEAAKKMAADTGDAAKQKSAEAAKCVEENAAKFTGEPAAPKEPTGNMFQQAGGQVMGAATGARDAVMNTLGMGGDKADVGSAK

SEQ ID NO: 5211 - protein, 175 aa, Triticum aestivum
MSGWFGGKTDAKADEAAKTGPSVQDRAIEAKDQTISFIGEKSEAVTKAASDTAEAAMKMGGDAMGKASETGQAITDRAIESKDQTFGFFGEKTEAAKKMAADTGDAAKQKSAEAAKCVEETAAKFTGEPVAPKEPTGNMFQQAGGQVMGAATGAKDAVMNTLGMGGDKADAGTAK

SEQ ID NO: 5212 - protein, 175 aa, Triticum aestivum
MSGWFGGKTDAKADEAAKTGPSVQDRAIEAKDQTISFIGEKSEAVTKAASDTADAAMKMGSDAMGKASETGQAITDRAIESKDQTFGFFGEKTEAAKKMAADTGDAAKQKSAEAAKCVEENAAKFTGEPAAPKEPTGNMFQQAGGQVMGAATGARDAVMNTLGMGGDKADTGTAK

SEQ ID NO: 5213 - protein, 175 aa, Secale cereale
MSGWFGGKTDAKAEEAAKTGPSVQDRAIEAKDQTISFIGEKSEAVTKAASDTADAAMKMGGDAMGKVSETGQAITDRAIESKDQTFGFFGEKTEAAKKMAVDTGDAAKQKSAEVAKCVEENAAKFNGEPAAPKEPTGNMFQQAGGQVMGAATGAKDAVMNTLGMGGGKADAGTAK

SEQ ID NO: 5214 - protein, 175 aa, Secale cereale
MSGWFGGKTDAKAEEAAKTGPSVQDRAIEAKDQTISFIGEKSEAVTKAASDTADAATKMGGDAMGKASETGQAITDRATESKDQTFGFFGEKTEAAKKMAVDTGDAAKQKSAEAAKCVEENAAKFTGEPAAPKEPTGNMFQQAGGQVMGAATGAKDAVMNTLGMGGGKADAGTAK

SEQ ID NO: 5215 - protein, 175 aa, Leymus cinereus x Leymus triticoides
  misc_feature (23)..(23): Xaa can be any naturally occurring amino acid
  misc_feature (64)..(64): Xaa can be any naturally occurring amino acid
  misc_feature (99)..(99): Xaa can be any naturally occurring amino acid
MSGWFGGQTDAKADEAAKTGPSXQDRAVEAKDQTISFIGEKSEAVTKAASDTAEAAMKMGGDAXGKASETGQAITDRAIESKDQTFGFLGEKTEAAKKXAVDTGDAAKQKSAEAAKCVEETAAQFTKEPAAPKEPTGNMFQQAGGQVMGAATGARDAVMNTLGMGGDKGDAGSAK

SEQ ID NO: 5216 - protein, 175 aa, Secale cereale
MSGWFGGKTDAKAEEAAKTGPSVQDRAIEAKDQTISFIGEKSEAVTKAASDTADAATKMGGDAMGKASETGQAITDRAIESKDQTFGFFGEKTEAAKKMAVDTGDAAKQKSAEVAKCVEENAAKFNGEPAAPKEPTGNMFQQAGGQVMGAATGAKDAVMNTLGMGGGKADADTAK

SEQ ID NO: 5217 - protein, 78 aa, Hordeum vulgare
MSCCGGNCGCGSACKCGNGCGGCNMYPEVEAAGATLLVAAAATHKASSGGMEMAAENGGCGCTQCKCGTSCGCSCCSC

SEQ ID NO: 5218 - protein, 78 aa, Unknown
  Sequence found in Organisms: Avena sativa, Triticum aestivum
MSCCGGNCGCGSACKCGNGCGGCNMYPEVEAAGATLLVSATATHKASSGGMEMAAENGGCGCTQCKCGTSCGCSCCSC

SEQ ID NO: 5219 - protein, 78 aa, Hordeum vulgare
MSCCGGNCGCGSACKCGNGCGGCNMYPEVEAAGATLLVAAAATHKASSGGMEMTAENGGCGCTQCKCGTSCGCSCCSC

SEQ ID NO: 5220 - protein, 78 aa, Unknown
  Sequence found in Organisms: Setaria italica, Triticum aestivum
MSCCGGNCGCGSACKCGNGCGGCNMYPEAEAAGATLLVSATATHKASSGGMEMAAENGGCGCTQCKCGTSCGCSCCSC

SEQ ID NO: 5221 - protein, 77 aa, Triticum aestivum
SCCGGSCGCGSACKCGNGCGGCNMYPEVEAAGATLLVAATATHKASSGRMEMAAENGGCGCTQCKCGTSCGCSCCSC

SEQ ID NO: 5222 - protein, 78 aa, Triticum aestivum
MSCCGGNCGCGTACKCGNGCGGCNMYPEVEAAGATLLVSATATHKASSGGMEMAAENGGCGCTQCKCGTSCGCSCCSC

SEQ ID NO: 5223 - protein, 78 aa, Secale cereale
MSCCGGSCGCGSACKCGNGCGGCNMYPEVEVAGATLLVSATATHKASSGGMEMAAENGGCGCTQCKCGTSCGCSCCSC

SEQ ID NO: 5224 - protein, 78 aa, Secale cereale
MSCCGGSCGCGSACKCGNGCGGCNMYPEVEAAGATFLVSATATHKASSGGMEMAAENGGCGCTQCKCGTSCGCSCCSC

SEQ ID NO: 5225 - protein, 108 aa, Secale cereale
MSCCGGNCGCGTACKCGNGCGGCNMYPEVEATGATFLVSATATHKASSGRRWRWRPRTAAAAAPSASAAPAAAAPAAAARSIIDHACTVPCVHRRIDLLLPYHRNRNL

SEQ ID NO: 5226 - protein, 78 aa, Secale cereale
MSCCGGSCGCGSSCKCGNGCGGCNMYPEVEAAGATLLVSATATHKASSGGMEMAAENGGCGCTQCKCGTSCGCSCCSC

SEQ ID NO: 5227 - protein, 78 aa, Avena sativa
MSCCGGNCGCGNACKCGNGCGGCNMYPEAEVAGATLLVAATATHKASSGGMEMAAENGGCGCTQCKCGTSCGCSCCSC

SEQ ID NO: 5228 - protein, 78 aa, Triticum aestivum
MSCCGGNCGCGTACKCGNGCGGCNMYPEAEAAGATLLVSATATHKASSGGMEMAAENGGCGCTQCKCGTSCGCSCCSC

SEQ ID NO: 5229 - protein, 77 aa, Triticum aestivum
SCCGGSCGCGSACKCGNGCGGCNMYPEVEAAGATLLVAATATHKASSGGMEMAAEDGGCGCTQCKCGTSCGCSCCSC

SEQ ID NO: 5230 - protein, 78 aa, Triticum aestivum
MSCCGGNCGCGTACKCGNGCGGCNMYPEVEAAGATLLVSATATHKGSSGGMEMAAENGGCGCTQCKCGTSCGCSCCSC

SEQ ID NO: 5231 - protein, 78 aa, Secale cereale
MSCCGGNCGCGTACKCGNGCGGCNMYPEVEATGATFLVSATATHKASSGGMEMAAENGGCGCTQCKCGTSCGCSCCSC

SEQ ID NO: 5232 - protein, 78 aa, Secale cereale
MSCCGGSCGCGSSCKCGNGCGGCNMYPEVEAAGATLLVSATATHKASSGGMEMAVENGGCGCTQCKCGTSCGCSCCSC

SEQ ID NO: 5233 - protein, 99 aa, Secale cereale
AHKKLIANQSLSISEAPTQPRMSCCGGNCGCGTACKCGNGCGGCNMYPEVEATGATFLVSATATHKASSGGMEMAAENGGCGCTQCKCGTSCGCSCCSC

SEQ ID NO: 5234 - protein, 78 aa, Gossypium hirsutum
MSCCGGNCGCGSACKCGNGCGGCNMYPEVEATGATLLVDAAVTHKASSGGMEMAAENGGCGCTQCKCGTSCGCSCCSC

SEQ ID NO: 5235 - protein, 77 aa, Triticum aestivum
SCCGGSCGCGSACKCGNGCGGCNMYPEAEAAGATLLVSATATHKASSGGMEMAAENGGCGCTQCKCGTSCGCSCCSC

SEQ ID NO: 5236 - protein, 78 aa, Triticum aestivum
MSCCGGNCGCGTACKCGNGCGGCNMYPEAEAAGTTLLVSATATHKASSGGMEMAAENGGCGCTQCKCGTSCGCSCCSC

SEQ ID NO: 5237 - protein, 103 aa, Secale cereale
MSCCGGNCGCGTACKCGNGCGGCNMYPEVEATGATFLVSATATHKASLRAAWRWRPRTAAAAAPSASAAPAAAALLQLLDRSSTMHAPCRACIVVSIYYYLTM

SEQ ID NO: 5238 - protein, 78 aa, Secale cereale
MSCCGGSCGCGSACKCGNGCGGCNMYPEVEAAGTTFLVSATATHKASSGGMEMAAENSGCGCTQCKCGTSCGCSCCSC

SEQ ID NO: 5239 - protein, 74 aa, Triticum aestivum
GGSCGCGSACKCGNGCGGCNMYPEVEAAGATLLVSATATHKASSGGMEMAAENGGCGCTQCKCGTSCGCSCCSC

SEQ ID NO: 5240 - protein, 76 aa, Secale cereale
CCGGNCGCGTACKCGNGCGGCNMYPEVEATGATFLVSATATHKASSGGMEMAAENGGCGCTQCKCGTSCGCSCCSC

SEQ ID NO: 5241 - protein, 75 aa, Triticum aestivum
MSCCGGNCGCGSACKCGNGCGGCNMYPEAEGRRRHPPPSPLPPPTRRVRRHGDGGGERRLPLHPMQVRHNCGCSC

SEQ ID NO: 5242 - protein, 78 aa, Secale cereale
MSCCGGSCGCGSSCKCGNSCGGCNMYPEVEAAGSTFLVSATATHKASSGGMEMAFENGGCGCTQCKCGTSCGCSCCSC

SEQ ID NO: 5243 - protein, 78 aa, Secale cereale
MSCCGGSCGCGSSCKCGNGCGGCNMYPEFEAAGATFLVSATATHKASSGGMEMTVENGGCGCTQCKCGTSCGCSCCSC

SEQ ID NO: 5244 - protein, 78 aa, Secale cereale
MSCCGGSCGCGSSCKCGNGCGGCNMYPEVEAAGATFLVSATATHKAAPAGMEMAVENGGCGCTQCKCGTSCGCSCCSC

SEQ ID NO: 5245 - protein, 102 aa, Secale cereale
MLAARKLRLRHRLQVRQRLRRLQHVPGGRGHRRHLPRLRHRHPQGELRRHGDGGRERRLRLHPVQVRHQLRLLLLQLLDRSSTMHAPCRACIVVSIYYYLTM

SEQ ID NO: 5246 - protein, 93 aa, Secale cereale
ANTNQSLHPIPSNLEDVLLRRKLRLRAAPASAATAAAAATCTGRLRQPAPPSSSPPPHPQGELRGMEMAVENGGCGCTQCKCGTSCGCSCCSC

SEQ ID NO: 5247 - protein, 78 aa, Triticum aestivum
  misc_feature (26)..(26): Xaa can be any naturally occurring amino acid
  misc_feature (29)..(29): Xaa can be any naturally occurring amino acid
  misc_feature (55)..(55): Xaa can be any naturally occurring amino acid
  misc_feature (64)..(64): Xaa can be any naturally occurring amino acid
MSCCGGNCGCGTACKCGNGCGGCNMXPEXEAAGATLLVSATATQKASSGGMEMAXENGGCGCTXCKCGTRCGCSCCSC

SEQ ID NO: 5248 - protein, 68 aa, Secale cereale
RQRLQVRQRLRRLQHVPGGRGRRRHLLVSATATHKASSGGMEMAAENGGCGCTQCKCGTSCGCSCCSC

SEQ ID NO: 5249 - protein, 67 aa, Setaria italica
MSCCGGSCGCGSACKCGNGCGGCNMYPEVEAAGATLLVAATATHKASSGGMEMAAENGGCGCTQCKC

SEQ ID NO: 5250 - protein, 282 aa, Triticum aestivum
MAAAAARSGSRRLFSISALVPPKPPTPPPKADPFASLFAPGLSKRTTTDGLREAFAKSGEVVHASSVKNSRWYMINANRSGPLTVRKEYRKVLPSFIRPSASYSTEASEKRPKQERTDLTTVEDPFNAPTYNIPEKPVTFVEGASYSVVILAGLGVAALAGYAVFKELIFEPKEYKIFGKALVRVQSDSQVTAKIGYPITGYGTESRNRAARQRIQNRVWTDEDGVEHVEVGFHIRGPHGAGKVFAEMFKDSSDRTWKFTFLLVEITSPRPAQIMLESYLPA

SEQ ID NO: 5251 - protein, 290 aa, Triticum aestivum
MAAAAARSGSRRLFSISALVPPKPPSPPPKADPFASLFVPGLSKRTVADGLRGAFAKSGEVVHGSLLTNLPASSVKKSRWYMINANRSGPLTVRKEYRKVLPSFIRPSASYSTQASEKRPKQERTDLTTVEDPFNAPTYNIPEKPVTFVEGASYSVVILAGLGVAALAGYAVFKELIFEPKEYKIFGKALARVQSDSQVTAKIGYPITGYGTESRNRAARQRIQNRVWTDEDGVEHVEVGFHIRGPHGAGKVFAEMFKDSSDRTWKFTFLLVEITSPRPAQIMLESYLPA

SEQ ID NO: 5252 - protein, 259 aa, Leymus cinereus x Leymus triticoides
  misc_feature (240)..(240): Xaa can be any naturally occurring amino acid
MAAAAARSGSRRLFSISALVPPKPPTPPPKADPFASFFVPASSVKNSRWYTINANRSGPLTVRKEYRKVLPSFIRPSASYSTQASEKRPKQERTDLTTVEDPFNAPTYKIPEKPVTFVEGASYSVVILAGLGVAALAGYAVFKELIFEPKEYKIFGKALARVQSDSQVTAKIGYPITGYGTESRNRAARQRIQNRVWTDEDGVEHVEVGFHIRGPHGAGKVFAEMFKDNSDRTWKFTFLXVEITSPRHAQIMLESYLPA

SEQ ID NO: 5253 - protein, 281 aa, Avena sativa
MAVAAARSGSRRLFSISAIVPRKLPNPPLKAESFPNLLVPGLSKQTTLGGLREAFPKSGEVGHASSSKSSRWYMINSNRSGSLTVRKECRKVLPSSIRPSASYSTQASENKPNQERTDLTTTEDPFDSPTYNIPEKPVTFVEGASYTVVILAGLGVAAVAGYAVFKELIFEPKEYKIFGKALARVQSDSQVTAKIGYPITGYGTESRNRAARQRIQNLWTDEDGVEHVEVGFHIRGPHGAGKVFAEMFKDNSDRTWKFTFLLVEITSPRHSQMMLESYIPA

SEQ ID NO: 5254 - protein, 435 aa, Triticum aestivum
MRCLPFLHGDGKSRDDDRRTGPSAAMSASVRSFSTESTERGDPRSGSDLNSINVSDMSAESIRRTQYPSFTDRPANLRVFTFPELKAATRNFSRSLMVGEGGFGCVYRGVIKGSDDPTERVEIAVKQLNRKGVQGQKEWLTEMNVLGIVEHPNLVKLIGYCADDDERGMQRLLVYEYMPNGSVDDHLASRSTSTLSWPMRLKVALDAARGLKYLHEEMDFQVIFRDLKTSNILLDENWNAKLSDFGLARHGPQEGLSHVSTAVVGTLGYAAPEYMQTGRLTAKSDIWGYGVLLYELITGRRPIDRNRPKGEQKLLDWVKPYISDIKRFPIIVDPRLEGHYNLKSMTRLAGVANRCLLRLPKTRPKMSEVYEMVQKIVDSVEVGPPEPPLHYHGSVSGPGAKRTKKGSLKRRLQEFKFGCRQIVWRGWKPEIIKTC

SEQ ID NO: 5255 - protein, 427 aa, Brachypodium distachyon
MGCLAFLHGESKEERPAPKSASVRSFSTTSTEREVPSGSDLTSMNISDMSAESIRRTQYPSFTDRPSNLRVFTFSELKNATRNFSRSLMVGEGGFGCVYRGIIKNSDEPNERIEIAVKQLNRKGVQGQKEWLTEMNVLGIVEHPNLVKLIGYCADDDERGMQRLLVYEYMPNGSVDDHLASRSTSTLSWPMRLKVALDAARGLKYLHEEMDFQVIFRDLKTSNILLDENWDAKLSDFGLARHGPQEGLSHVSTAVVGTLGYAAPEYMQTGRLTAKSDMWSYGVLLYELITGRRPIDKNRPKGEQKLLDWVKPYISDVKRFPIIVDPRLEGHYNLKSVTKLAAVANRCLVRLPKSRPKMSEVYEMVQKIVDSIETGPPQPPLHYHGSVSEPGAKRTKKGSLKRRFQEFKFGCRQIVWRGWKPEIIKTC

SEQ ID NO: 5256 - protein, 427 aa, Oryza sativa
MRCLPFLHGDSKEEDPVNKSASVRSLSTTSTERDVRSGSDFNSLNVSDMSAESIRRTQYPSFTDRPSNLRVFSFSELKNATRNFSRSLMVGEGGFGCVYRGVIKNSDEPTERTEIAVKQLNRKGLQGQKEWLTELNVLGIVEHPNLVKLIGYCAEDDERGVQRLLVYEYMPNGSVDDHLSSRSNSTLSWPMRLKVALDAARGLKYLHEEMEFQVIFRDLKTSNILLDENWNAKLSDFGLARHGPSEGLTHVSTAVVGTLGYAAPEYMQTGRLTAKSDIWGYGVLLYELITGRRPIDRNRPKGEQKLLDWVKPYISDIKRFPIIIDPRLEGHYNLKSMTKLASVANRCLVRLPKSRPKMSEVYEMVQKIVASIETGTPQPPLHYHGSVSEPGSKRPKKGSLKRRFQEFKFGCRQIVWRSWKPEIIKTC

SEQ ID NO: 5257 - protein, 427 aa, Setaria italica
MRCLPFWHGEVKEEDPVTMSASVRSISTTSTERDVRSGSDFTSLNVSDMSAESIRRTQYPSFTDRPSNLRVFSFAELKSATRNFSRSLMVGEGGFGCVYRGIIKTSDEPNERIEIAVKQLNRKGLQGQKEWLTEMNVLGIVDHPNLVKLIGYCAEDDERGVQRLLVYEYMLNGSVDDHLSSRSTSTLSWPMRLKVALDSARGLKYLHEEMEFQVIFRDLKTSNILLDENWNAKLSDFGLARHGPTEGLTHVSTAVVGTLGYAAPEYMQTGRLTAKSDIWSYGVLLYELITGRRPIDRNRPKSEQKLLEWVKPYVGDKKRFPIIIDPRLEGHYNLKSMLKLSSVANRCLVRMPKSRPKMSEVYEMVQKIVDSVETGPPQPPLHYHGSVSEPGAKRTKKGSLKRRLQEFKFGCRNIVWRGWKPEIVKTF

SEQ ID NO: 5258 - protein, 431 aa, Zea mays
MRCLPFLHGDTKEKDPVTKSASLRSMSTTSTERDVRSGSDFTSLNVSDMSAESIRRTQYPSFTDRPSNLRVFSFAELKSATRNFSRSLMVGEGGFGCVYRGVIKTSDEPNERIEIAVKQLNRKGLQGQKEWLTEMNVLGIVDHPNLVKLIGYCAEDDERGVQRLLVYEYMPNGSVDDHLSSRSTSTLSWPMRLKVALDSARGLKYLHEEMEFQVIFRDLKTSNILLDENWNAKLSDFGLARHGPAEGLTHVSTAVVGTLGYAAPEYMQTGRLTAKSDIWSYGVLLYELITGRRPIDRNRPKSEQKLLDWVKPYISDVKRFPIIVDPRLEGHYNLKSMTKLSSVANRCLVRMPKSRPKMSEVYDMVQKIVDCVGTGPPQPPLLHYHGSASEPGPGDKRARKGSVKRRRLWELRFGCRHIVWRGWKPAIVKDI

SEQ ID NO: 5259 - protein, 422 aa, Sorghum bicolor
MKCLPFLHGDAKEKDPVTKSASVRSMSTTSTERDVRSGSDFTSLNVSDMSAESIRRTQYPSFTDRPPNLRVFSFAELKSATRNFSRSLMVGEGGFGCVYRGVIKNSDEPSERIEIAVKQLNRKGLQGQKEWLTEMNVLGIVDHPNLVKLIGYCADDDERGVQRLLVYEYMPNGSVDDHLSSRSTSTLSWPMRLKVALDSARGLKYLHEEMEFQVIFRDLKTSNILLDENWDAKLSDFGLARHGPAEGLTHVSTAVVGTLGYAAPEYMQTGRLTAKSDIWSYGVLLYELITGRRPIDKNRPKSEQKLLDWVKPYISDVKRFPIIVDPRLEGHYNLKSMTKLSSVANRCLVRMPKSRPKMSEVYDMVQKIVDSIGTGPPQPPLLHYRGSASDPATKRAKKGSLRTRLREFGLGCRNIVQRGWKA

SEQ ID NO: 5260 - protein, 426 aa, Zea mays
MRCLPFLHGDVSEKDPVTKSASVRSMSTTSRSRSGSDFTSLNVSDMSAESIRRTQYPSFTDCPSNLRVFSFAELKSATRNFSRSLMLGEGGFGCVFSGIIKTSDKPNERIEIAVKQLNRKGLQGQKEWLTEMNVLGIVDHPNLVKLIGYCAEDDERGVQRLLVYEYMPNGSVDDHLSSRSTTLSWPMRLKVALDSARGLKYLHEEMEFQVIFRDLKTSNILLDENWNAKLSDFGLARHGPTEGLTHVSTAVVGTLGYTAPEYMQTGHLTAKSDIWSYGVVLYELITGRRPIDQNRPKSEQKLLDWVKPYISDVKRFPVIIDPRLEGHYNLKSATKLASVANRCMVRLPKSRPKMSEVYGMVQRIVDGVGTGPPQPPLLHYHHGSASEPGAKRAEKGSLRRRFREFRSGCRHVVLRRGRKPEVVKDL

SEQ ID NO: 5261 - protein, 250 aa, Brachypodium distachyon
MNYEFNRSSLAERRIFLAHYQTITYSQTSCGANRFHLPSHGKPFSFRLALSGILVIGSIRTGRSYLVKYLTKNYDFPFIKVRGLLIPQERKHLFILSYTRGFYLEKTMFHTKRFGCITTSSSALDLVALSNEALSISIPHKKSIIEKNTIRLTLHRQTCGLRAKVRSARDHGTFFYQIGGALVQNRLISNNPIESIYLYKEAIVSGSGFFFGQKVLRTWNEHEEINETSFSFAFLWRTCRARSLVFPWNR

SEQ ID NO: 5262 - protein, 128 aa, Brachypodium distachyon
MVKPELLEERIFNSITWAPRIWRPWDNPFDCRVLFRSKDIRGGQFVRPILIFRTKRYWILFRIGPERRRKAEMPTDLCLFSNSPEPIVPVFGTSSAKVTEWVSHQSNPFDKSGVILDIIFYIYRNIIE

SEQ ID NO: 5263 - protein, 258 aa, Pseudoroegneria spicata
MSSAAPAPEEQPPRPVRFGIMGCASIARKLARAMLLAAPAAAVAAVGSRSEAKARLFAADNGLPAGARLHGSYEALLDDPGVDAVYLPLPTSLHVQWATAAAARGKHVLLEKPTALCAADLDAILAACDASGVQFMDSTMWMHHPRTAKMRELLPADVGDVRVINSLFSFRANEDFLQNDIRVKPDLDALGALGDAGWYCIRAILWAVDYELPKNVIALPDPVKNKAGVLIACGATLYWADGKIATFHCSFLTNLTWT

SEQ ID NO: 5264 - protein, 368 aa, Leymus cinereus x Leymus triticoides
  misc_feature (42)..(42): Xaa can be any naturally occurring amino acid
  misc_feature (282)..(282): Xaa can be any naturally occurring amino acid
MSSAAPAPEQPPRPVRFGIMGCASIARKLARAMLLAAPAAAXAAVGSRSEAKARLFAADNGLPADARLHGSYEALLDDPGVDAVYLPLPTSLHVQWATAAAARGKHVLLEKPTALCAADLDAILAACENSGVQFMDSTMWMHHPRTAKMRELLPADVGDVRVINSLFSFRANEDFLQNDIRVKPDLDALGALGDAGWYCIRAILWAVDYELPKNVMALPDPVKNQAGVLIACGATLYWADGKIATFHCSFLTNLTMDLTIVGTDGTLHVTDFVIPYEEKSGXFSVASRSNFAELHTGWVPQPSKHVVMTDLPQEALMVKEFCRLVQGIRDAGAKPEGKWPAITRKTQVVMDAVKESIDNGFKSVDVAS

SEQ ID NO: 5265 - protein, 369 aa, Secale cereale
MSSAAPAPEEQGPRPVRFGIMGCASIARKLARAMLLAAPAAAVAAVGSRSEAKARLFAADNGLPADARLHGSYEALLDDPAVDAVYLPLPTSLHVRWATAAAARGKHVLLEKPTALCAADLDAILAACDAGGVQFMDSTMWMHHPRTAKMRDLFPADVGDVRVINSLFSFRANEDFLQNDIRVKPDLDALGVLGDAGWYCIRAILWAVDYELPKNVIALPDPVKNKAGVLIACGAALYWADGKMATFHCSFLANLTMDLTVIGTDGTLHVTDFIIPYEEKSGPFSVASRSNFAELHTGWVPQPSKHVVTTDLPQEALMVREFCRLVQGIRDGGAKPEGKWPAITRKTQVVMDAVKASIDNGFKSVDVAS

SEQ ID NO: 5266 - protein, 369 aa, Secale cereale
MSSAAPAPEEQPPRPVRFGIMGCASIARKLARAMLLAAPACAVAAVGSRSEAKARLFAADNGLPAEARLHGSYEALLDDPAVDAVYLPLPTSLHVQWATAAAARGKHVLLEKPTALCAADLDAILAACDAGGVQFMDSTMWMHHPRTAKMRDLLPADVGDVRVINSMFSFRANEDFLENDIRVKPDLDALGALGDAGWYCIRAILWAVDYELPKNVIALSDPVKNQAGVLIACGATLYWADGKMATFHCSFLANLTMDLTVVGTDGTLHVTDFIIPYEEKSGPFSVASKSNFAELSIGWVPQPSKHVVMTDLPQEALMVQEFCRLVRGIRDAGAKPEGKWPAITRKTQVVMDAVKTSIDNGFGSVDVVS

SEQ ID NO: 5267 - protein, 369 aa, Triticum aestivum
MSSAAPAPEEQRPRPVRFGIMGCASIARKLARAMLLAAPAGAVTAVGSRSEAKARLFAADNGLPAKARLHGSYEALLDDPAVDAVYLPLPTSLHVQWATAAAARGKHVLLEKPTALCAADLDAILAACDASGVQFMDSTMWMHHPRTAKMRDLLPADVGDVRVINSLFSFRANEDFLQNDIRVKPDLDALGVLGDAGWYCIRAILWAVNYELPKNVIALPDPVKNQAGVLIACGATLYWADGKTATFHCSFLANLTMDLTVVGTDGTLHVTDFIIPYEEKSGPFSVASRSNFAELHTGWVPQPSRHVVTTDLPQEALMVQEFCRLVQGIRDAGAKPEGKWPAITRKTQVVMDAVKASIDKGFESVDVVS

SEQ ID NO: 5268 - protein, 368 aa, Avena sativa
MSSAAAPENPRPVRFGIMGCASIARKLARAMLLAAPAAAVVAVGSRSEGKARLFAADNGLPAATRLHGSYEALLDDPDVDAVYLPLPTSLHVKWATAAAARGKHVLLEKPTALCAAELDAILAACEENGVQFMDSTMWMHHPRTAKMRELLDDRSTIGDVRVINSVFSFRANEDFLHNDIRVKPDLDALGALGDAGWYCIRAILWAVNYELPRNVIALCDPVKNQAGVLLACSATLYWADGKIATFHCSFLTNLTMDVTVVGTNGTLHVTDFIIPYEEKSGPFSVASESNFAELHTGWVPQPSKHVVTTELPQEALMVQEFCRLVQEIRDGGAGVERKWPGITRKTQIVMDAVKTSIDDGFVSVDVTS

SEQ ID NO: 5269 - protein, 368 aa, Avena sativa
MSSAAAPENPRPVRFGIMGCASIARKLARAMLLAAPAAAVVAVGSRSEGKARLFAADNGLPAATRLHGSYEALLDDPDVDAVYLPLPTSLHVKWATAAAARGKHVLLEKPTALCAAELDAILAACEENGVQFMDSTMWMHHPRTAKMRELLDDRSTIGDVRVINSVFSFRANEDFLHNDIRVKPDLDALGALGDAGWYCIRAILWAVNYELPRNVIALCDPVKNQAGVLLACSATLYWADGKIATFHCSFLTNLTMDVTVVGTNGTLHVTDFIIPYEEKSGPFSVASESNFAELHTGWVPQPSKHVVTTELPQEALMVQEFCRLVQEIRDGGAGVERKWPGITRKTQIVMDAVKTSIDDGFVSVNVTS

SEQ ID NO: 5270 - protein, 371 aa, Sorghum bicolor
MSSAAAPDPDQPPRPVRFGILGCASIARKLARAMLLAPGAAVAAVGSRSEEKARLFAADNGLDVAATRLHGSYEAILDDPDVDAVYLPLPTSLHVRWATAAAARGKHVLLEKPTALCAADLDAILAACDAAGVQFMDSTMWMHHPRTARMRDTVDDKDAIGDIATINSVFSFRANEDFLQNDIRVKPDLDALGALGDAGWYCIRAILWAVGYELPKTVIALRDPVKNRAGVLLACGATLYWADGKTATFSCSFLSNLTMDITLVGTNGTIHVTDFVIPYEENLAEFHVASKSSFAELHIGWDPLPSKHVITTDLPQEALMVQEFARLVQEIRDAGCKPEGKWPAITRKTQLVLDAVKASIDKGSEPVEVAS

SEQ ID NO: 5271 - protein, 369 aa, Zea mays
MSSAAVPDQSPRPVRFGILGCAAIARKLARAMLLAPGAAVAAVGSRSEVKARLFAADNGLDVATTRLHGSYDALLDDPDIDAVYMPLPTSLHVRWATAAAARGKHVLLEKPTALCAADLDTILAACDTAGVQFMDSTMWMHHPRTAKMRETVDNKDAIGDIRTINSVFSFRANEDFLQNDIRVKPGLDALGALGDAGWYCIRAILWAVDYELPKTVIALRDPVKNQAGVLLACGATLYWSDGKTATFSCSFLTNLTMDITLVGTNGTVYVTDFVIPYEEKSAEFPVASKSNFAELHVGWDPLPSKHVVATDLPQEALMVQEFARLVQNIRDAGGKPEGKWPAITRKTQLVLDAVKASIDKGSAPVEVAS

SEQ ID NO: 5272 - protein, 385 aa, Panicum virgatum
  misc_feature (1)..(1): Xaa can be any naturally occurring amino acid
  misc_feature (4)..(4): Xaa can be any naturally occurring amino acid
  misc_feature (6)..(8): Xaa can be any naturally occurring amino acid
  misc_feature (11)..(12): Xaa can be any naturally occurring amino acid
  misc_feature (15)..(17): Xaa can be any naturally occurring amino acid
  misc_feature (19)..(21): Xaa can be any naturally occurring amino acid
  misc_feature (90)..(90): Xaa can be any naturally occurring amino acid
XVTXAXXXREXXPAXXXAXXXSSHQPPRPVRFGILGCASIARKLARAMLLAPGAAVAAVGSRSEEKARLFAADNGLDVATTRLHGTYEAXLDDPDVDVVYLPLPTSLHVRWATAAAARGKHLLLEKPTALCAADLDAILAACDAAGVQFMDSTMWMHHPRTAKMRELVDDKDAIGDIKVINSVFCFRANEDFLQNDIRVKPDLDALGALGDVGWYCIRAILWAVDYELPKTVIALRDPVKNQSGVLLACGATLYWADGKTATFSCSFLTNLTMDITLVGTNGTLHVTDFVIPYEEKSAEFSVASKSNFAQLHIGWDPLPSKHVVTTDLPQEALMVQEFARLVQNIRDAGGKPEGKWPAITRKTQVVLDAVKASIDKGSEPVEIAN

SEQ ID NO: 5273 - protein, 412 aa, Triticum aestivum
MEMVLAAAANCTGALSSNHPKTFLKSRRSSLQMRACRSGPAAPLAVSSAAAPEEPRPVRLGIMGCGSIARKVARSMLLVPAADVAAVASRSEGKARLFAADNGLRSGTRIHGSYEALLDDPDVDAVYMPLPTSLHVKWATAAAERGKHLLLEKPTAPCAADLEPILAACEANGVQFMDSTMWMHHPRTAKMRQLVADQDTIGDVRFINTMVSFLANEDFLQNDIRVKPDLDGLGVLGDIGWYCIRGILWAVDYELPKNVVALHHPVKNQAGVLLACGASLYWADGKVATFHCSFLTNLTMDLTVVGTNGTIHVTDLVIPYEEKSAPFSVDSKTNFAELSTGWDPHPSKHVVTTDLPQEGLMVQEFCRLVQGIRDAGVKPEGKWPGITRKTQIVVDAVKASIDNGFESVDVAS

SEQ ID NO: 5274 - protein, 366 aa, Brachypodium distachyon
MSSAMPEEPRPVRFGIMGCATIARKVARAMLLAPAANVAAVGSRSEEKARAFAADNGLPAGVRLHGSYEGLVDDPDLDAVYIPLPTSLHVKWAAAAAARGKHVLLEKPTALCAADLDAILAACESNRVQFMDSTMWMHHPRTAKMRELVANKGTIGDVRVINTVFSFQADEDFLHNDIRVKPDLDALGALGDVGWYCIRAILWAVDYELPKSVAAFRNPVKNQAGVLLACGATLYWADGKIATFHCSFLTNLTMDITVVGTNGNLHVTDFVIPYEEKSAPFSVASKSSFAELHTGWDPHPSKHVVTTDLPQEALMVQEFSRLVQSVRDAGSKPERNWPAITRKTQIVMDAVKTSIDSESEPVNVAS

SEQ ID NO: 5275 - protein, 367 aa, Leymus cinereus x Leymus triticoides
MSSAAAPEEPRPVRLGIMGCGSIARKVARSMLLVPAADVAAVASRSEGKARLFAADNGLQSGTRIHGSYEALLDDPDIDAVYMPLPTSLHVKWATTAAERGKHLLLEKPTAPCAADLEPILTACEANGVQFMDSTMWMHHPRTAKMRQLVADQDTIGDVRFVNTMVSFLANEDFLQNDIRVKPDLDGLGVLGDIGWYCIRGILWAVDYELPKNVVALRHPVKNQAGVLLACGASLYWADGKVATFHCSFLTNLTMDLTVVGTNGTIHVTDLVIPYEENSAPFSVASKTNFAELSTGWDPHPSKHVVTTDLPQEALMVQEFCRLVQSIRDAGVKPEGKWPGITRKTQIVVDAVKTSIDNGFESVDVAS

SEQ ID NO: 5276 - protein, 411 aa, Secale cereale
MEMVLAAANCTGAFSSNHPKKFLKSRRSSVQMPACRSGPDAPLAVSSAAAPEEPRPVRLGIMGCGSIARKVARSMLLVPAADVAAVASRSEGKARLFAADNGLRSGTRIHGSYQALLDDPDIDAVYMPLPTSLHIKWATAAAERGKHLLLEKPTAPCATDLEPILAACEANGVQFMDSTMWMHHPRTARMRQLVADQDTVGDVRFINTMVSFLANEEFLQNDIRVKPDLDGLGVLGDIGWYCIRGILWAVDYELPKNVVALRQPVKNQAGVLLACGASLYWADGKVATFHCSFLTNLTMDLTVVGTNGTIHVTDLVIPYEEKSAPFSVASKTNFAELSTGWDPHPSKHVVTTELPQEALMVQEFCRLVQGIRDAGVKPEGKWPGITRKTQIVVDAVKASIDNGFESVDVAS

SEQ ID NO: 5277 - protein, 350 aa, Brachypodium distachyon
MGCATIARKVARAMLLAPAANVAAVGSRSEEKARAFAADNGLPAGVRLHGSYEGLVDDPDLDAVYIPLPTSLHVKWAAAAAARGKHVLLEKPTALCAADLDAILAACESNRVQFMDSTMWMHHPRTAKMRELVANKGTIGDVRVINTVFSFQADEDFLHNDIRVKPDLDALGALGDVGWYCIRAILWAVDYELPKSVAAFRNPVKNQAGVLLACGATLYWADGKIATFHCSFLTNLTMDITVVGTNGNLHVTDFVIPYEEKSAPFSVASKSSFAELHTGWDPHPSKHVVTTDLPQEALMVQEFSRLVQSVRDAGSKPERNWPAITRKTQIVMDAVKTSIDSESEPVNVAS

SEQ ID NO: 5278 - protein, 323 aa, Secale cereale
QPLPGQGPPLRRRNGSPPEARPARLLPRRSSTTRPSTPSTLPGPHQPPRAVGHRRRRAGQARAPREAHRALRRRPRRHPRRLRRRRRPVHGLHHVDAHPRTAEMRDLSPPTSATSEVINSLFSFRANEDFLQNDIRVKPDLDALGVLGDAGWYCIRAILWAVDYELPKNVIALPDPVKNKAGVLIACGATLYWADGKMATFHCSFLANLTMDLTVIGTDGTLHVTDFIIPYEEKSGPFSVASRSNFAELHTGWVPQPSKHVVTTDLPQEALMVKEFCRLVQRIRDAGAKPEGKWPAITRKTQVVMDAVKASIDNGFKSVDVAS

SEQ ID NO: 5279 - protein, 380 aa, Oryza sativa
MSSPSSAASPPPPPPAEQRRPDPVRFGIMGCASIARKLARAMLLAPGAAVAAVGSRSEAKARAFAEETGLLLRHAPRLHGSYEALLADPGVDAVYLPLPTSLHVRWATAAAAAGKHVLLEKPTALCAADLDAILAACDAAGVQFMDATMWMHHPRTAKMRELVADEATTGDVRVINSLFSFRANEEFLQNDIRVKPDLDALGTLGDAGWYSIRAILWAVDYELPKTVIALRNPVRNQAGVLLACGATLYWADGKIATFNCSFLTNLTMDMTIVGTNGTLHVTDFVIPYEEKYAAFNMASKSKFAELHIGWDPLPSKHVVSTDLPQEALMVQEFSRLVQNIRDAGGKPEGKWPAITRKTQVVMDAVKTSIDNRFGPVDISS

SEQ ID NO: 5280 - protein, 66 aa, Unknown
  Sequence found in Organisms: Secale cereale, Triticum aestivum
MQAKKLTLLQTVAAAGVFSAVSFWYGFMFGRESARRELGGIIDDLRSGSTATSAAPSSDSHAHPKP

SEQ ID NO: 5281 - protein, 66 aa, Triticum aestivum
MQAKKLTLLQTVAAAGVFSAVSFWYGFMFGRESARRELGGIIDDLRSGSTATSAAPSPDSHAHPKP

SEQ ID NO: 5282 - protein, 166 aa, Secale cereale
LSPPGAAGSPFLSSFDPLRRRRRRRRRRHVRARVQPPNPRLSEACLSNGFPHCCLSADGELPPAPNPSGRCSRRADAAADGGCRRSLLSRLLLVRLHVWEGVCTARSWRHHRRPSQRLHGHLRRALLRLPRSPQTIVRSCSTVSRRWVLEELPSSSGKKEHSQMKV

SEQ ID NO: 5283 - protein, 84 aa, Lolium multiflorum
ERCRRKQADSAAARWPLQEFSRPSPAGTASCLVGSLPGVSLVASLTTSVAAPRRPLLRPLTPTLPPNPSVILLYTVKNKNGHHK

SEQ ID NO: 5284 - protein, 66 aa, Sorghum bicolor
MQAKKLTLLETVAAAGVFSAVSFWYGFMFGRESARRELGGIIDDLRSNKPTTTAAASSDTDAHPKP

SEQ ID NO: 5285 - protein, 65 aa, Brachypodium distachyon
MAAKKLTLLQTVAAAGVFSAVSCWYGFMFGRESARRELGGIIDDLRNSSSTGSAASPDSHTPSKR

SEQ ID NO: 5286 - protein, 62 aa, Setaria italica
MQAKKLTLLQTVAAAGVFSAVSCWYGFMFGRESARRELGGIIDDLRKSTTTASSEPDANSKP

SEQ ID NO: 5287 - protein, 378 aa, Triticum aestivum
MDLRAFFGGKKQEPEQNGHANGAAPNGGVKKRTADLAIYEQYEQQARQPEMRAAAIRDGNADVIQKPLLPQFESAEMRNLAETLLRDIIRGSPDVQWESIKGLETAKRLLKEAVVMPIKYPKYFTGLLSPWKGILLFGPPGTGKTMLAKAVATECNTTFFNISASSIVSKWRGDSEKLVKVLFELARHHAPSTIFLDEIDAIISQRGEARSEHEASRRLKTELLIQMDGLTKTNDLVFVLAATNLPWELDAAMLRRLEKRILVPLPEAEARHAMFKELLPAMTSNLEVPYDILVEKTEGYSGSDIRLVCKEAAMQPLRRLMSVLEASDELVPEEELPEVGPLKPEDVELALSNTRPSAHLQAHRYEKFNQDYGSHILS

SEQ ID NO: 5288 - protein, 385 aa, Saccharum officinarum
MDFKGFWESRFGGKKEPEQQNGHANGEANGSVRKRTSDLAVYEQFEQQARQTQVRAAAIRDGNADVIQKPLLPSFESAEMRNLAETLLRDIIRGSPDVKWESIKGLENAKRLLKEAVVMPIKYPKYFTGLLSPWKGILLFGPPGTGKTMLAKAVATECKTTFFNISASSIVSKWRGDSEKLVKVLFELARHHAPSTIFLDEIDAIISQRGEARSEHEASRRLKTELLIQMDGLTKTNDLVFVLAATNLPWELDAAMLRRLEKRILVPLPEAEARQAMFEELLPATTSKLEVPYNILVEKTEGYSGSDIRLVCKEAAMQPLRRLMSVLEASDELVPEEELPEVGPLKPEDIELALRNTRPSAHLHAHRYEKFNQDYGSQVLCSELA

SEQ ID NO: 5289 - protein, 378 aa, Secale cereale
MDLRAFFGGKKQEPEQNGHANGAAPNGSVKKRTPELAIYEQYEQQARQPEMRAAAIRDGNADVIQKPLLPQFESAEMRNLAETLLRDIIRGSPDVQWESIKGLETAKRLLKEAVVMPIKYPKYFTGLLSPWKGILLFGPPGTGKTMLAKAVATECNTTFFNISASSIVSKWRGDSEKLVKVLFELARHHAPSTIFLDEIDAIISQRGEARSEHEASRRLKTELLIQMDGLTKTNDLVFVLAATNLPWELDAAMLRRLEKRILVPLPEAEARHAMFKELLPAMTSNLEVPYDILVEKTEGYSGSDIRLVCKEAAMQPLRRLMSVLEASDELVPEEDLPEVGPLKPEDVELALSNTRPSAHLQAHRYEKFNQDYGSHILS

SEQ ID NO: 5290 - protein, 378 aa, Secale cereale
MDLRAFFGGKKQEPEQNGHANGAAPNGSVKKRTPELAIYEQYEQQARQPEMRAAAIRDGNADVIQKPLLPQFESAEMRNLAETLLRDIIRGSPDVQWESIKGLETAKRLLKEAVVMPIKYPKYFTGLLSPWKGILLFGPPGTGKTMLAKAVATECNTTFFNISASSIVSKWRGDSEKLVKVLFELARHHAPSTIFLDEIDAIISQRGEARSEHEASRRLKTELLIQMDGLTKTNDLVFVLAATNLPWELDAAMLRRLEKRILVPLPEAEARHAMFKELLPAMTSNLEVPYDILVEKTEGYSGSDIRLVCKEAAMQPLRRLMSVLEANDELVPEEELPEVGPLKPEDVELALSNTRPSAHLQAHRYEKFNQDYGSHILS

SEQ ID NO: 5291 - protein, 373 aa, Hordeum vulgare
MDLRAFFGGKKQEPEQNGHANGGVKKRTADLAIYEQYEQQARQPEMRAAAIRDGNADVIQKPLLPQFESAEMRNLAETLLRDIIRGSPDVQWESIKGLETAKRLLKEAVVMPIKYPKYFTGLLSPWKGILLFGPPGTGKTMLAKAVATECNTTFFNISASSIVSKWRGDSEKLVKVLFELARHHAPSTIFLDEIDAIISQRGEARSEHEASRRLKTELLIQMDGLTKTKDLVFVLAATNLPWELDAAMLRRLEKRILVPLPEAEARHSMFKELLPAMTSNLEVPYDILVEKTEGYSGSDIRLVCKEAAMQPLRRLMSVLEASDELVPEEELPEVGPLKPDDVELALSNTRPSAHLQAHRYEKFNQDYGSHILS

SEQ ID NO: 5292 - protein, 386 aa, Oryza sativa
MDFKGFWESRFGGKKEQEPEQNGHANGVANGSVRKRTSDLAVYEQFEQQARQTEVRAAAIRDGNADAIQKPLLPSFESAEMRNLAETLLRDIIRGSPDVKWESIKGLENAKRLLKEAVVMPIKYPKYFTGLLSPWKGILLFGPPGTGKTMLAKAVATECKTTFFNISASSIVSKWRGDSEKLVKVLFELARHHAPSTIFLDEIDAIISQRGEARSEHEASRRLKTELLIQMDGLTKTNDLVFVLAATNLPWELDAAMLRRLEKRILVPLPEAEARHAMFEELLPSTTSKLEVPYDTLVEKTEGYSGSDIRLVCKEAAMQPLRRLMSVLEARDELVPEEELPEVGPLKPEDIEVALRNTRPSAHLHAHRYEKFNQDYGSQILSQEQA

SEQ ID NO: 5293 - protein, 381 aa, Sorghum bicolor
MDFKGFWESRFGGKKEPEEQNGHANGSVPKRTSDLAVYEQFEQQARQTQVRAAAIRDGNADVIQKPLLPSFESAEMRNLAETLLRDIIRGSPDVKWESIKGLENAKRLLKEAVVMPIKYPKYFTGLLSPWKGILLFGPPGTGKTMLAKAVATECKTTFFNISASSIVSKWRGDSEKLVKVLFELARHHAPSTIFLDEIDAIISQRGEARSEHEASRRLKTELLIQMDGLTKTNDLVFVLAATNLPWELDAAMLRRLEKRILVPLPEAEARQAMFEELLPATTSKLEVPYNILVEKTEGYSGSDIRLVCKEAAMQPLRRLMSVLEASDELVPEEELPEVGPLKPEDIELALRNTRPSAHLHAHRYEKFNQDYGSQVLCSESA

SEQ ID NO: 5294 - protein, 386 aa, Panicum virgatum
MDFKGFWESRFGGKKEREPEQNGSANGEANGSAPKRTADLAVYEQFEQQARQTQVRAAAIRDGAADVIQKPLLPPFESAEMRNLAETLLRDIIRGSPDVKWESIKGLENAKRLLKEAVVMPIKYPKYFTGLLSPWKGILLFGPPGTGKTMLAKAVATECKTTFFNISASSIVSKWRGDSEKLVKVLFELARHHAPSTIFLDEIDAIISQRGEARSEHEASRRLKTELLIQMDGLTKTNDLVFVLAATNLPWELDAAMLRRLEKRILVPLPEAEARQAMFEELLPATTSKLEVPYNVLVEKTEGYSGSDIRLVCKEAAMQPLRRLMSVLEASDELVPEEELPEVGPLKPEDIEIALRNTRPSAHLHAHRYEKFNQDYGSQVLCSEHA

SEQ ID NO: 5295 - protein, 385 aa, Pennisetum glaucum
MDFKGFWESRFGGKKEPEQNGHANGESNGSAPKRTADLAVYEQFEQQARQTQVVRAAAIRDGNADVIQKPLLPPFESAEMRNLAETLLRDIIRGSPDVKWESIKGLENAKRLLKEAVVMPIKYPKYFTGLLSPWKGILLFGPPGTGKTMLAKAVATECKTTFFNISASSIVSKWRGDSEKLVKVLFELARHHAPSTIFLDEIDAIISQRGEARSEHEASRRLKTELLIQMDGLTKTNDLVFVLAATNLPWELDAAMLRRLEKRILVPLPEAEARQAMFEELLPETTSKLEVPYDVLVEKTDGYSGSDIRLVCKEAAMQPLRRLMSVLEASDELVPEEELPEVGPLKPEDIEIALRNTRPSAHLHAHRYEKFNQDYGSHVLCSEQA

SEQ ID NO: 5296 - protein, 383 aa, Zea mays
MDFKGFWESRFGGKKEPEPEQNGHANGVQNQKRTSDLAVYEQFEQQARQTQVRAAAIRDGDADVIQKPLLPSFESAEMRNLAETLLRDIIRGSPDVKWESIKGLENAKRLLKEAVVMPIKYPKYFTGLLSPWKGILLFGPPGTGKTMLAKAVATECKTTFFNISASSIVSKWRGDSEKLVKVLFELARHHAPSTIFLDEIDAIISQRGEARSEHEASRRLKTELLIQMDGLTKTNDLVFVLAATNLPWELDAAMLRRLEKRILVPLPEGEARQAMFEELLPATTSKLEIPYDILVEKTEGYSGSDIRLVCKEAAMQPLRRLMSVLEASDELVPEEELPEVGPLKPDDIELALRNTRPSAHLHAHRYEKFNQDYGSHVVCSELA

SEQ ID NO: 5297 - protein, 386 aa, Cenchrus ciliaris
  misc_feature (15)..(15): Xaa can be any naturally occurring amino acid
  misc_feature (17)..(17): Xaa can be any naturally occurring amino acid
  misc_feature (58)..(58): Xaa can be any naturally occurring amino acid
  misc_feature (62)..(62): Xaa can be any naturally occurring amino acid
MDFKGFWESRFGGKXEXEQNGHANGNGDANGSAPKRTADLAVYEQFEQQARQTQVRAXAIRXGNADVIQKPLLPPFESAEMRNLAETLLRDIIRGSPDVKWESIKGLENAKRLLKEAVVMPIKYPKYFTGLLSPWKGILLFGPPGTGKTMLAKAVATECKTTFFNISASSIVSKWRGDSEKLVKVLFELARHHAPSTIFLDEIDAIISQRGEARSEHEASRRLKTELLIQMDGLTKTNDLVFVLAATNLPWELDSAMLRRLEKRILVPLPEAEARQAMFEELLPETTSKLEVPYDVLVEKTEGYSGSDIRLVCKEAAMQPLRRLMSVLEASNELAPEEELPEVGPLKPEDIEIALRNTRPSAHLHAHRYEKFNQDYGSHVLCSEQA

SEQ ID NO: 5298 - protein, 378 aa, Panicum virgatum
MDFKGFWESRFGGRKEREPEQNGSAPKRTADLAVYEQFEQQARQTQVRAAAIRDGAANVIQKPLLPPFESAEMRNLAETLLRDIIRGSPDVKWESIKGLENAKRLLKEAVVMPIKYPKYFTGLLSPWKGILLFGPPGTGKTMLAKAVATECKTTFFNISASSIVSKWRGDSEKLVKVLFELARHHAPSTIFLDEIDAIISQRGEARSEHEASRRLKTELLIQMDGLTKTNDLVFVLAATNLPWELDAAMLRRLEKRILVPLPEAEARQAMFEELLPAITSKLEVPYDVLVEKTEGYSGSDIRLVCKEAAMQPLRRLMSVLEASDELVPEEELPEVGPLKPEDIEIALRNTRPSAHLHAHRYEKFNQDYGSQVLCSEQA

SEQ ID NO: 5299 - protein, 389 aa, Setaria italica
ANSSSQDFKGFWESRFGGKKEPEQNGSANGDANGAAPKRTADLAVYEQFEQQARQTQVRAAAIRDGNADVIQKPLLPPFESAEMRNLAETLLRDIIRGSPDVKWESIKGLENAKRLLKEAVVMPIKYPKYFTGLLSPWKGILLFGPPGTGKTMLAKAVATECKTTFFNISASSIVSKWRGDSEKLVKVLFELARHHAPSTIFLDEIDAIISQRGEARSEHEASRRLKTELLIQMDGLTKTNDLVFVLAATNLPWELDAAMLRRLEKRILVPLPEAEARQAMFEELLPETTSKLEVAYDVLVEKTEGYSGSDIRLVCKEAAMQPLRRLMSVLEASNELVPEEELPEVGPLKPEDIELALRNTRPSAHLHAHRYDKFNQDYGSQVLCSEQA

SEQ ID NO: 5300 - protein, 366 aa, Setaria italica
DDGRPPLRGSDPLSGRPAVSRANGGADLAVFEQFERMERKVEMRNGAIEDGPPQKPLLPSFESAETRNLAETLLRDIIRGSPDVKWESIKGLENAKRLLKEAVVMPIKYPKYFTGLLSPWKGILLFGPPGTGKTMLAKAVATECKTTFFNISASSIVSKWRGDSEKLVKVLFELARHHAPSTIFLDEIDAIISQRGEARSEHEASRRLKTELLIQMDGLTKTDELVFVLAATNLPWELDAAMLRRLEKRILVPLPEPDARHAMFEELLPSTTGTMEIPYDVLVEKTEGYSGSDIRLVCKEAAMQPLRRLMTVLERNQEVPEDELPEVGPVTTEDIELALRNTRPSAHLHAHRYEKFNQDYGSHVHG

SEQ ID NO: 5301 - protein, 400 aa, Secale cereale
MISAERSQSQSPRSPGAAAGAPFLSICVTDPVKMGTGVQSYISYRVITKTNLPEFEGAEKIVIRRYSDFEWLHDRLAEKYKGIFVPPLPEKNAVEKFRFSKEFIELRRQALDLFINRLASHPELKQSEDLRTFLQADEEKMDRARSYETGIFKKPGDFIQMFKDVQSKVSDVVLGKEKPVEESTPEYEKLKHYIFELENHLAEAQKQAFRLVKRHRELGQSLADFGKAIKLLGVCEGDSLEKVFSEVGSKSEMLSIKLQREADNLLFNFEEPLKDYVRAVQSIKATMLDRANAFRQHFDLDQERKYKELNLEKMKLMNPDKFSESETEFSELKAASEEATKRYEHIVSVMNDELARFQEQKTADIGLAFHEFAKGQAKLAKDIADAWRSVLPKLEACSTS

SEQ ID NO: 5302 - protein, 193 aa, Triticum aestivum
MAAATARQLLVHRITSSCSSGTLPKHSSSSHGRSAYSSMCFNKAEKLPSFRARVSVKPPHAVPGKGGIVPADDDGVSLGTVKLPANIDVARFEGLLFQWGNSLCQGAMLPLPVPIKVDKVEGGIRLGFIGIDDGATSLLAYIDCLVSPATDGSGFVFRAIRNGAMKDMEPPGEPRIMRSLLMALQKSIQIAQV

SEQ ID NO: 5303 - protein, 193 aa, Hordeum vulgare
MAAATARQLLVHRITSSCSSGTLPKHASSSHGISAYSSRCFHKAEKLPGFRARVPVKPPRAVPGKAGIVPADDDGVSLGTVKLPANIDVARFEGLLFQWGNSLCQGAMLPLPVPIKVDKVEGGIRLGFIGIDDGATSLLAYIDCLVSPATDGSGFVFRATRNGAMKDMEPPGEPRIMRSLLMALQKSIQIAQV

SEQ ID NO: 5304 - protein, 191 aa, Avena sativa
MAAATARQLLVHRITSSCSSGTLPKHTFNSHGFHATSSCFKAEKLPSFRARLAIAPPRAVPGKGGIVPANDDGVSLGTVKLPGNIDVARFEALLFQWGNSLCQGAMLPLPVPIKVDKVEGGIRLGFIGIDDGATSLLAYIDCLVSQAPDGSGLVFQAIRNGAMKNMEPPGEPRIMRSLLQALQTSIRLSQV

SEQ ID NO: 5305 - protein, 1959 aa, Oryza sativa
MAAPGGARRPDFSSAASPSPSPAGAAGRRLLRTQTVGNLGESIFDSEVVPSSLVEIAPILRVANEVEATNPRVAYLCRFYAFEKAHRLDPTSNGRGVRQFKTALLQRLERENDPTLKGRVHQSDAREMQRFYREYYKKYIQALQNAADKADRALLTKAYQTAAVLFEVLKAVNVSQSVEVDQAILDTHNKVEEKKKLYVPYNILPLDPESTYQPIMQYPEIQAAVNALRNIRGLPWPKEHEKKPDEKKTGKDLLDWLQAMFGFQKDNVSNQREHLILLLANVHIRQSPKTEQQAKLDDRALDAVMKKLFKNYKKWCKYLGRKSSLWLPTIQQEVQQRKLLYMGLYLLIWGEAANLRFMPECLCYIYHHMAFELYGMLAGNVSPMTGENVKPAYGGDEEAFLMKVVTPIYKVIEKEAERSKTIKSKHSHWRNYDDLNEYFWSVDCFRLGWPMRADADFFKTPEDAYPSRLNGENRSAGNVHWMGKINFVEIRSFWHIFRSFDRMWIFLILSLQAMIIIAWNGGTPSDIFDVGVFKQVLSIFITAAVLKLGQAILDIVFGWKARRSMSFAVKLRYVLKLISSSAWVVILPVTYAYTWDSPTGLARIIKSWLGNGQNQPSLYILAVVIYLAPNMLAAMLFLFPFLRRFLESSNVKVITFIMWWSQPRLFVGRGMHEGAFSLFKYTMFWVLLLAMKLTVSFYIEIKPLVQPTKDIMKEPIRDFQWHEFFPRANNNIGVVIALWAPIILVYFMDTQIWYALFSTLIGGIYGAYRRLGEIRTLGMLRSRFESLPEAFNEHLIPSDSHKSKGLRAAFTGKPSKTSGDEQEKEKIAARFAQMWNLIITSFREEDLIDNREMDLLLVPYCKDRELNIFQWPPFLLASKIPIALDMAADSGGKDRDLKKRMGSDPYFSYAIRECYGSFKNIINTLVFGQREKIVIQQIFTIVDEHIEGGSLIKDLNMRSLPALSKKFIELLELLQKNKEEDLGQVVILFQDMLEVVTRDIMDEQDQLGGLLDSVHGGNRKHEGMTSLDQQDQLFTKAIRFPVEESNAWTEKIKRLHLLLTVKESAMDVPTNLDARRRISFFANSLFMEMPNAPKVRHMLPFSVLTPYYKEDVLFSSHNLEEPNEDGVSILFYLQKIYPDEWKNFLDRVDRKSEEELREDETLEEELRLWASYRGQTLTRTVRGMMYYRKALELQAFLDMAKDDDLMEGYRATELMSEDSQLMTQCKAIADMKFTYVVSCQQYGIQKRSGEACAHDILRLMTVYPSLRVAYIDEVEAPSQDRNKKTDKVYYSALVKASVTKPNEPGQSLDQVIYKIKLPGNAILGEGKPENQNHAIIFTRGECLQTIDMNQEHYMEEALKMRNLLDEFLKKHDGVRYPSILGVREHIFTGSVSSLAWFMSNQETSFVTIGQRVLANPLRVRFHYGHPDIFDRLFHLTRGGVSKASKIINLSEDIFAGFNSTLREGNVTHHEYMQVGKGRDVGLNQIALFEAKIANGNGEQTLSRDIYRLGHRFDFFRMLSCYYTTIGFYFSTMITVWTVYVFLYGRLYLVLSGLDQALATGKKFVHNAPLQVALASESFVQLGFLMALPMMMEIGLERGFRTALSDFVLMQLQLASVFFTFSLGTKTHYYGRTLLHGGAEYRATGRGFVVFHAKFADNYRLYSRSHFVKGIELMILLVVYEIFGQSYRGAITYIFITVSMWFMVGTWLFAPFLFNPSGFEWQKIVDDWTDWNKWISNRGGIGVAPTKSWESWWEKEQEPLRYSGKRGTILEILLALRFFVYQYGLVYHLNITKHTRSVLVYCFSWVVIFVILLVMKTVSVGRRRFSAEFQLVFRLIKGLIFITFVAIVVILIAIPHMTVLDIFVCILAFMPTGWGLLLIAQAIKPAVQAIGLWGSIKALARGYEILMGLLLFTPIAFLAWFPFVSEFQTRMLFNQAFSRGLQISRILGGHKKDRSTRNKE

SEQ ID NO: 5306 - protein, 1965 aa, Sorghum bicolor
MAAPGRRTADVSSSSPAPSPSPAAPSSTGRRLLRTQTVGNLGESIFDSEVVPSSLVEIAPILRVANEVEATNPRVAYLCRFYAFEKAHRLDPTSSGRGVRQFKTALLQRLERENDPTLKGRVHQSDAREMQRFYREYYKKYIQALQNAADKADRALLTKAYQTAAVLFEVLRAVNVSQSVEVDQAILDTHNKVEEKKKLFLPCNILPLDPESTGQAIMLYPEIQAAVYALRNTRGLPWPKDQDKKPDEKNTGKDLLDWLQAMFGFQKDNVSNQREHLILLLANVHIRKIPKADLQPKLDDKALDDVMKKLFKNYKKWCKYLGRKSSLWLPTIQQEVQQRKLLYMGLYLLIWGEAANLRFMPECICYIYHHMAFELYGMLAGNVSPMTGENVKPAYGGDEEAFLMKVVTPIYKVIEKEAERSKTMKSKHSHWRNYDDLNEYFWSVDCFRLGWPMRADADFFKTPKDAYPNLLNGENRSAGNVHWMGKVNFVEIRSFWHIFRSFDRMWIFLILSLQAMIIIAWNGGTPSDIFDAGVFKKVLSIFITAAILKLGQAILDLVFGWKARRSMSFAVKLRYVLKLISAAAWVVILPVTYAYTWENPTGLARTIKSWLGDGQNQPSLYILAIVIYMAPNILASMLFLFPFMRRFLESSNVKVITIMMWWSQPRLFVGRGMHEGAFSLFKYTMFWIILLAMKLIVSFYIEIKPLVQPTKDIMREPIRTFQWHEFFPHGTNNIGVVISLWAPIILVYFMDTQIWYALFSTLIGGIYGAYRRLGEIRTLGMLRSRFESLPEAFNERLIPSDANKSKGLRAAFLSRPKVPGDEREREKRAARFAQMWNVIITSFREEDLIDNREMDLLLVPYCKDRELDIFQWPPFLLASKIPIALDMAADSGGKDRDLTKRIKSDPYFSFAIRECYASFKNIINTLVFGQREKDVLAKIFTVVDEHIEDGTLIKDLNMRNLPALSKKFVELLELLQKNKEEDLGQVVILFQDMLEVVTRDIMEEQDQLSTLLDSIHGAHSRKHEGITPLDQQDQLFAKAIKFPVEESNAWTEKIKRLHLLLTVKESAMDVPTNLDARRRISFFANSLFMDMPNAPKVRNMLPFSILTPYYKEDVLFSLQNLEEPNEDGVSILFYLQKIYPDEWKNFLERVGCKNEEELREDEELEEKLRLWASYRGQTLTRTVRGMMYYRKALELQAFLDMAKDDDLMEGYRATEVMPEDSQLMTQCKAIADMKFTYVVSCQQYGIQKRSNEPCAHDILRLMTEYPSLRVAYIDEVEAPSQDRNKKIEKVYYSVLVKASVTKPNEPGQSLDQVIYKIKLPGNAILGEGKPENQNHAIIFTRGECLQTIDMNQEHYMEEALKMRNLLQEFQKKHDGVRYPSILGVREHIFTGSVSSLAWFMSNQETSFVTIGQRVLANPLRVRFHYGHPDVFDRLFHVTRGGVSKASKIINLSEDIFAGFNSTLREGNVTHHEYMQVGKGRDVGLNQISLFEAKIANGNGEQTLSRDIYRLGHRFDFFRMLSCYYTTIGFYFSTMITVWTVYVFLYGRLYLVLSGLDEALATGRRFVRNAPLQVALASESFVQLGFLMALPMMMEIGLERGFRTALSDFILMQLQLASVFFTFSLGTKTHYYGRTLLHGGAEYRATGRGFVVFHAKFADNYRLYSRSHFVKGIELMILLVVYEIFGQSYRGAITYIFITVSMWFMVGTWLFAPFLFNPSGFEWQKIVDDWTDWHKWISNRGGIGVAPEKSWESWWEKEQEPLRYSGKRGTIVEILLALRFFIYQYGLVYHLNITKKITKDNQSVLVYCFSWVVIFVILLVMKTVSVGRRRFSAEFQLVFRLIKGLIFITFTAIVVILIAIPGMTVLDIFVCILAFMPTGWGLLLIAQAIRPVIQKIGLWGSIKALARGYEILMGLLLFTPIAFLAWFPFVSEFQTRMLFNQAFSRGLQISRILGGHKKDRGTRNKE

SEQ ID NO: 5307 - protein, 1960 aa, Zea mays
MAAPGRRTADVSSSSPAPSPSPSTGRRLLRTQTVGNLGESIFDSEVVPSSLVEIAPILRVANEVEATNPRVAYLCRFYAFEKAHRLDPTSSGRGVRQFKTALLQRLERENDPTLKGRVHQSDAREMQRFYREYYKKYIQALQHAADKADRALLTKAYQTAAVLFEVLRAVNVSQSVEVDQAILDTHNKVEEKKKLYVPYNILPLDPESTGQAIMRYPEIQAAVYALRNTRGLPWPKDQDKKPGEKNTGKDLLDWLQAMFGFQKDNVSNQREHLVLLLANVHIMKVPKVDQQPKLDDKALDAVMKKLFKNYKKWCKYLGRKSSLWLPTIQQEVQQRKLLYMGLYLLIWGEAANLRFMPECICYIYHHMAFELYGMLAGNVSPMTGENVKPAYGGDEEAFLIKVVTPIYKVIEKEAERSKTMKSKHSHWRNYDDLNEYFWSVDCFRLGWPMRADADFFKTPKDAYLNLLNGENRSAGNTHWMGKVNFVEIRSFWHIFRSFDRMWIFLILSLQAMIIIAWNGGTPSDIFDAGVFKKVLSIFITAAILKLGQAILDLIFGWKARRNMSFAVKLRYILKLICAAAWVVILPVTYAYTWENPTGLARTIKSWLGDGQNQPSLYILAIVIYMAPNIVASMLFLFPFMRRFLESSNVKVITIIMWWSQPRLFVGRGMHEGAFSLFKYTMFWVLLLATKLTVSFYIEIKPLVQPTIDIMREPIRTFQWHEFFPHGTNNIGVVISLWAPIILVYFMDTQIWYALFSTLIGGIYGAYRRLGEIRTLGMLRSRFESLPEAFNERLIPSDANKSKGLRAAFSSRPKASGDERQKEKRAARFAQMWNVIITSFREEDLIDNREMDLLLVPYCKDRELDIFQWPPFLLASKIPIALDMAADSGGKDRDLTKRIKSDPYFSFAIRECYASFKNIINTLVFGQREKDVLAQIFAVVDQHIEDETLIKDLNMRNLPALSKKFVELLELLQKNKEEDLGQVVILFQDMLEVVTRDIMEEQDQLGTLLESAHGANSRKHEGITPLDQQDQLFAKAIKFPVDESIAWTEKIKRLHLLLTVKESAMDVPTNLDARRRISFFANSLFMDMPNAPKVRNMLAFSILTPYYKEDVLFSLQNLEEPNEDGVSILFYLQKIYPDEWKNFLERVGCKNEEGLREDEELEEKLRLWASYRGQTLTRTVRGMMYYRKALELQAFLDMAEDDDLMEGYRATEVMPEDSQLMTQCKAIADMKFTYVVSCQQYGIQKRSNEPCAHDILRLMTEYPSLRVAYIDEVEAPSQDRNKKIEKVYYSVLVKASVTKPDEPGQSLDQVIYKIKLPGNAILGEGKPENQNHAIIFTRGECLQTIDMNQEHYMEEALKMRNLLQEFEKKHGVRYPSILGVREHIFTGSVSSLAWFMSNQETSFVTIGQRVLANPLRVRFHYGHPDIFDRLFHITRGGVSKASKIINLSEDIFAGFNSTLREGNVTHHEYMQVGKGRDVGLNQISLFEAKIANGNGEQTLSRDIYRLGHRFDFFRMLSCYYTTIGFYFSTMITVWTVYVFLYGRLYLVLSGLDEALATGRRFVHNAPLQVALASESFVQLGFLMALPMMMEIGLERGFRTALSDFILMQLQLASVFFTFSLGTKTHYYGRTLLHGGAEYRATGRGFVVFHAKFADNYRLYSRSHFVKGIELMILLVVYEIFSQPYRGAVTYIFITVSMWFMVGTWLFAPFLFNPSGFEWQKIVDDWTDWHKWISNRGGIGVAPEKSWESWWEKEQEPLRYSGKRGTVVEILLALRFFIYQYGLVYHLNITKKITKDNQSVLVYCFSWVVIFVILLVMKTVSVGRRRFSAEFQLVFRLIKGLIFITFTAIVVILIAIPGMTVLDIFVCILAFMPTGWGLLLIAQAIRPVIHKTGLWGSIKALARGYEILMGLLLFTPIAFLAWFPFVSEFQTRMLFNQAFSRGLQISRILGGHKKDRGTRNKE

SEQ ID NO: 5308 - protein, 1251 aa, Setaria italica
MSSSSPSPSPAAPPSSGRRLLRTQTVGNLGESIFDSEVVPSSLVEIAPILRVANEVEATNPRVAYLCRFYAFEKAHRLDPTSSGRGVRQFKTALLQRLERENDPTLKGRVHQSDAREMQRFYREYYKKYIQALQNAADKADRALLTKAYQTAAVLFEVLRAVNVSQSVEVDQAILDTHNKVEEKKKLYVPYNILPLDPESTNQAIMRYPEIQAAVYALRNIRGLPWPKDHEKKPDDKNTGKDLLDWLQGMFGFQKDNVSNQREHLILLLANVHVRKIPKAEQQPKLDDQALDAVMKKLFKNYKKWCKYLGRKSSLWLPTIQQEVQQRKLLYMGLYLLIWGEAANLRFMPECLCYIYHHMAFELYGMLAGNVSPMTGENVKPAYGGDEEAFLMKVVTPIYKVIEKEAERSKTIKSKHSHWRNYDDLNEYFWSVDCFRLGWPMRADADFFKTPKDAYPNRLNGENTSVGSVHWMGKVNFVEIRSFWHIFRSFDRMWIFLILSLQAMIILAWNGGTPSDIFDTKVFKQVLSIFITAAVLKLGQALLDIIFGWKARRSMSFAVKLRYVLKLISAAAWVVILPVTYAYTWENPTGLARTIKSWLGGGQNQPSLYILAVVVYLAPNMLASMLFLFPFLRRYLESSNVKVITFMMWWSQPRLFVGRGMHEGAFSLFKYTMFWVLLLAMKLTVSFYIEIKPLVQPTKDIMREPIRTFQWHEFFPHGSNNIGVVIALWAPIILVYFMDTQIWYALFSTLIGGIYGAYRRLGEIRTLGMLRSRFESLPVAFNERLIPSDANKRKGLRAAFSRKPKASDDEKEEEKRAARFAQMWNLIITSFREEDLIDNREMDLLLVPYCKDRELNIFQWPPFLLASKIPIALDMAADSGGKDRDLTKRMGSDPYFSYAIRECYASFKNIINTLVFGQREKLVIKEIFDVVDKHIAEETLIRDLTMRSLPALSKKFIDLLELLQKNKEEDLGQVVILFQDMLEVVTRDIMEEEQLGGMLESIHGGHNRRHEGITPLDQQDQLFAKAIRFPMEESDAWTEKIKRLHLLLTVKESAMDVPTNLDARRRISFFANSLFMEMPNAPKVRNMLPFSVLTPYYKEDVLFSSQNLEEPNEDGVSILFYLQKIYPDEWKNFLERVDRKSEEELREDEELEEELRLWASYRGQTLTRTVRGMMYYRKALELQAFLDMAQDDDLMEGYRATELMSEDSQLMTQCKAIADMKFTYVVSCQQYGIQKRSGEPCAHDILRLMTT

SEQ ID NO: 5309 - protein, 1858 aa, Secale cereale
RLERENDPTLKGRVHQSDAREMQRFYREYYKKYIQALQNAADKADRALLTKAYQTAAVLFEVLKAVNVSQSVEVDQAILDTHNKIEEKKKLYVPYNILPLDPESTDQAIMQNPEIQAAVYALRNIRGLPWPKDKEQEKKQEKKPDEKKTDRDLLDWLQSMFGFQKDNVANQREHLILLLANVHIRQIPKPEQQSKLDDRALDTVMKKLFKSYKMWCKYLGRKSSLWLPTIQQEVQQRKLLYMGLYLLIWGEAANLRFMPECLCYIYHHMAFELYGMLAGNVSPMTGENVKPAYGGDEEAFLMKVVTPIYRVIEEEALRSKTMKSKHSHWRNYDDLNEYFWKVDCFRLGWPMRADADFFKTPKFAYPNRLNGEERSAGSVHWMGKINFVEIRSFWHIFRSFDRMWIFLILSLQAMIIIAWNGGTPSDIFDAGVFKQVLSIFITAAVLKLGQATLDIVFGWKARRSMSFARKLRYVLKLVSAAAWVVILPVTYAYTWSNPSGLSRIIKSWLGNGQNQPSLYILAVVIYLAPNILAATLFLFPCIRRRLESSNVKVITFMMWWSQPRLFVGRGMHEGPFSLFKYTMFWVLLLAMKLIVSFYIEIKPLVQPTKDIMREPIRNFQWHEFFPNASNNIGVVIALWAPIILVYFMDTQIWYAVFSTLIGGIYGACRRLGEIRTLGMLRSRFESLPWAFNKLLIPSDQHKRKGFRAAFSTKLAKPSGNEQEREKIAARFAQMWNLIITSFREEDLIDNREMDLLLVPYCKDRELDIFQWPPFLLASKIPIALDMAADSGGNYRDLNKRMKSDPYFSYAIRECYASFKNIINTLVFGQREKIVMQEIFEVVDKHIAEETLIKDLNMRSLPALSKKLIELLELLQKNKVEDLGQVVILFQDMLEVVTKDIMEEQELSSVLDSIHGGNAKKHEGMTPLDQQDQLFTKAIKFPVEASNAWTEKIKRLHLLLTVKESAMDVPTNLDARRRISFFANSLFMDMPNAPKVRNMLPFSVLTPYYKEDVLFSSDNLEEANEDGITILFYLQKIYPDEWKNFLERVNRTEEEARDDDTIEDELRLWASYRGQTLTRTVRGMMYYRKALELQAFLDNAKDDDLMKGYREIADMKESELMTECKALADMKFTYVVSCQQYGIQKRSGDPCAHDILRLMTTYPSFRVAYIDEVEAPSQDRNKKTDKVYYSVLVKAAVTKSDDPGQSLDQVIYKIKLPGNAILGEGKPENQNHAIIFTRGECLQTIDMNQEHYMEEALKMRNLLEEFLEKHDGVRYPSILGVREHIFTGSVSSLAWFMSNQETSFVTIGQRVLANPLRVRFHYGHPDIFDRLFHLTRGGISKASKIINLSEDIFAGFNSTLREGNVTHHEYMQVGKGRDVGLNQISLFEAKIANGNGEQTLSRDIYRLGHRFDFFRMLSCYYTTIGFYFSTMITVWTVYAFLYGRLYLVLSGLDAALATGKRFVHNTPLQVALASESFVQLGFLMALPMMMEIGLERGFRTALSDFVLMQLQLASVFFTFSLGTKTHYYGRTLLHGGAEYRATGRGFVVFHAKFAENYRLYSRSHFVKGIELMILLVVYEIFGQTYRGAITYIFITVSMWFMVGTWLFAPFLFNPSGFEWQKIVDDWTDWNKWISNRGGIGVAPEKSWESWWDKEQGPLRHSGKRGTILEILLALRFFIYQYGLVYHLNITKQYNQSVLVYGFSWVVILVMLLVMKTVSVGRRRFSAEFQLVFRLIKGLIFITFISILIILTAIAHMTVLDIFVCILAFMPTGWGLLLIAQAMKPVVEMVGLWGSVKALARGYEILMGLLLFTPIAFLAWFPFVSEFQTRMLFNQAFSRGLQISRILGGHKKDRATRNKE

SEQ ID NO: 5310 - protein, 1956 aa, Setaria italica
MASSSGGRRMAPGGDSSSASPASAGAGAGPRRILRTQTAGNLGESIFDSEVVPSSLVEIAPILRVANEVEASNPRVAYLCRFYAFEKAHRLDPTSSGRGVRQFKTALLQRLERENDPTLKGRVKQSDAREMQSFYQHYYKKYIQALQNAADKADRAQLTKAYQTAAVLFEVLKAVNVSQKIEVDQSILETHNQVEEKKKLYLPYNILPLDPDSANQAIMRYPEIQAAFHALRNTRGLPWPKEHEKKPDADLLGWLQAMFGFQKDNVSNQREHLILLLANVHIRQIPKPDQQPKLDDRALDTVMKKLFKNYKKWCKYLGRKSSLWLPTIQQEVQQRKLLYMGLYLLIWGEAANLRFMPECLCYIYHHMAFELYGMLAGNVSPTTGENVKPAYGGEEEAFLKKVVTPIYKVIEKEAERSKIVKSKHSHWRNYDDLNEYFWSRDCFRLGWPMRADADFFKTPNDDRRHPVNGEDRPVANGNWMGKVNFVEVRSFWHIFRSFDRMWSFLILSLQAMIIIAWNGGTPSDIFDRGVFKQVLSIFITAAILKLGQAILDIILSWKARKNMSLVVKLRYILKLLSAAAWVVILPVTYAYTWQNPTGLARTIKSWLGDGQNQPSLYILAVVVYLAPNILSAVLFLFPVIRRALERSNLKVVTFMMWWSQPRLFVGRGMHEGAFSLFKYTMFWVLLLATKLVVSFYVEIKPLVQPTQDIMKEPIRTFKWHEFFPHANNNIGVVIALWAPIILVYFMDTQIWYAIFSTIVGGIYGACRRLGEIRTLGMLRSRFESLPKAFNQCLIPSDTSKRRGFRAAFSSKPSKTPEGTKEEEKIAARFAQIWNLIITSFREEDLINNREKDLLLVPYCKDRDMDIIQWPPFLLASKIPIALDMAADSGGKDRDLKKRMKSDPYFTYAIKECYASFKNIIYALVIGPRERDVIQKIFDVVDEHIAGDTLITELNMSNLPTLSKKFIELLDLLQKNNIEDQGQVIILFQDMLEVVTRDIMDEQLSGLLESIHGGNNRRYEGITPLDQQVQLFTKAIDFPVKETQAWTEKIKRLHLLLTVKESAMDVPTNLDARRRISFFANSLFMSMPRAPKVRQMLPFSVLTPYYKEDVLFSSHALEEPNEDGVSILFYLQKIYPDEWNNFLQRVDCKNEEELRETEQSEEELRLWASYRGQTLTRTVRGMMYYRQALVLQAFLDMARDEDLMEGFRAADLLSDESQLLTQCKAIADMKFTYVVSCQQYGIQKRSGDPRAQDILRLMTTYPSLRVAYIDEVEEPSKDRNKKIEKVYYSALVKAAVTKPDDPGQKLDQDIYRIKLPGNAMLGEGKPENQNHAIIFTRGEGLQTIDMNQEHYMEETLKMRNLLQEFLKKHDGVRYPSILGVREHIFTGSVSSLAWFMSNQETSFVTIGQRVLANPLRVRFHYGHPDIFDRLFHLTRGGVSKASKIINLSEDIFAGFNSTLREGNVTHHEYMQVGKGRDVGLNQISLFEAKIANGNGEQTLSRDVYRLGHRFDFFRMLSCYYTTIGFYFSTMITVWTVYVFLYGRLYLVLSGLDEALATGKRFIHNEPLQVALASQSFVQLGFLMALPMMMEIGLERGFRTALSDFVLMQLQLASVFFTFSLGTKTHYYGTTLLHGGAEYRATGRGFVVFHAKFAENYRLYSRSHFVKGIELMILLIVYEIFGQSYRGAIAYIFITISMWFMVVTWLFAPFLFNPSGFEWQKIVDDWTDWNKWISNRGGIGVPPEKSWESWWEKEQEPLRLSGKRGIILEIVLALRFFIYQYGLVYHLNITTHTKSVLVYCLSWVVIFVILLVMKTVSVGRRRFSAEFQLVFRLIKGLIFITFISIIIILIAIPHMTVQDMFVCILAFMPTGWGLLLIARAIKPAITKFQLWGSIKALARGYEIIMGLLLFTPIAFLAWFPFVSEFQTRMLFNQAFSRGLQISRILGGHKKDRATRNKE

SEQ ID NO: 5311 - protein, 1969 aa, Oryza sativa
MASSSSGRRVGGPRGGGESSPSPAAGAGAAASGGRRILRTQTAGNLGESIFDSEVVPSSLVEIAPILRVANEVEGSNPRVAYLCRFYAFEKAHRLDPTSSGRGVRQFKTALLQRLERENDPTLKGRVKQSDAREMQSFYQHYYKKYIQALQNAADKADRAQLTKAYQTAAVLFEVLKAVNVSQKIEVDQAILETHNQVEEKKKLYLPYNILPLDPDSANQAIMRYPEIQAAFHALRNTRGLPWPKDHEKKPDADLLGWLQAMFGFQKDNVSNQREHLILLLANVHIRQIPKPDQQPKLDDRALDTVMKKLFKNYKRWCKYLGRKSSLWLPTIQQEVQQRKLLYMGLYLLIWGEAANLRFMPECLCYIYHHMAFELYGMLAGNVSPTTGENVKPAYGGDEEAFLKKVVTPIYKVIEKEAERSESSERSERSKTTKSKHSHWRNYDDLNEYFWSRDCFRLGWPMRADADFFKTPDYAYHDEVSGENRRVGSGQWMGKVNFVEIRSFWHIFRSFDRMWSFLILSLQAMIIIAWNGGTPSDIFDAGVFKQVLSIFITAAILKLGQAILDIILSWKARRSMSLAGKLRYILKLISAAAWVVILPVTYAYTWENPTGLARTIKSWLGDGQNQPSLYILAVVIYLAPNMLSAVLFLFPVLRRALERSNLKVVTFMMWWSQPRLFVGRGMHEGAFSLFKYTMFWVLLLATKLIVSYYVEIKPLVRPTKDIMKEPIRTFQWHEFFPHGNNNIGIVIALWAPIILVYFMDTQIWYAIFSTLIGGIYGACRRLGEIRTLGMLRSRFESLPKAFNQRLIPSDSNKRRGIRAAFSSKPTKTPEDSKEEEKIAARFAQIWNLIITSFREEDLIDNREKDLLLVPYCKDRDMDIIQWPPFLLASKIPIALDMAADSEGKDRDLKKRVKSDPYFTYAIKECYASFKNIIYTLVVGAKERDVIQKIFTVVDDHIAQDTLIKELNMSNLPTLSKKFIELLELLQKNNKEDQGQVIILFQDMLEVVTRDIMDEQLSGLLESVHGGNNRRYEGITPLDQQDQLFTKAIDFPVKESHAWTEKIKRLHLLLTVKESAMDVPTNLDARRRISFFANSLFMDMPSAPKVRHMLPFSVLTPYYKEDVLFSSQALEDQNEDGVSILFYLQKIYPDEWKHFLQRVDCNTEEELRETEQLEDELRLWASYRGQTLTRTVRGMMYYRQALVLQAFLDMARDEDLREGFRAADLLNDESPLLTQCKAIADMKFTYVVSCQQYGIQKRSGDHRAQDILRLMTTYPSLRVAYIDEVEEPSKDRNKKIEKVYYSALVKAAVTKPDDPGQKLDQDIYRIKLPGNAMLGEGKPENQNHAIIFTRGEGLQTIDMNQEHYMEETLKMRNLLQEFLKKHDGVRYPSILGVREHIFTGSVSSLAWFMSNQETSFVTIGQRVLANPLRVRFHYGHPDIFDRLFHLTRGGVSKASKIINLSEDIFAGFNSTLREGNVTHHEYMQVGKGRDVGLNQISLFEAKIANGNGEQTLSRDVYRLGHRFDFFRMLSCYYTTIGFYFSTMMTVWTVYVFLYGRLYLVLSGLDEALATGKRFIHNEPLQVALASQSFVQLGFLMALPMMMEIGLERGFRTALSDFVLMQLQLASVFFTFSLGTKTHYYGTTLLHGGAEYRATGRGFVVFHAKFAENYRLYSRSHFVKGIELLILLIVYEIFGQSYRGAIAYIFITFSMWFMVVTWLFAPFLFNPSGFEWQKIVDDWTDWNKWISNRGGIGVPPEKSWESWWEKEQEPIKYSGKRGIVLEIVLALRFFIYQYGLVYHLNITKHTKSVLVYCLSWVVIFVILLVMKTVSVGRRKFSADFQLVFRLIKGLIFITFISIIIILIAIPHMTVQDIFVCILAFMPTGWGLLLVAQAIKPVIVRIGLWGSIKALARGYEIIMGLLLFTPIAFLAWFPFVSEFQTRMLFNQAFSRGLQISRILGGHKKDRATRNKE

SEQ ID NO: 5312 - protein, 1955 aa, Brachypodium distachyon
MASSSGRRMGPGGEGPPSSASPASGGPAGRRILRTQTAGNLGESSFDSEVVPSSLVEIAPILRVANEVEASNPRVAYLCRFYAFEKAHRLDPTSSGRGVRQFKTALLQRLERENDPTLKGRVKQSDAREMQSFYQHYYKKYIQALQNAADKADRAQLTKAYQTAAVLFEVLKAVNVSQKIEVDQAILETHNQVEEKKKLYLPYNILPLDPDSANQAIMQYPEIQAAFHALRNTRGLPWPKEHEKKSDADLLDWLQAMFGFQTDSVSNQREHLILLLANMHIRQISKPDQQSKLDDGALDKVMKKLFKNYKRWCKYLGRKSSLRLPTIQQEVQQRKLLYMGLYLLIWGEAANLRFMPECLCYIYHHMAFELYGMLAGNVSPTTGENVKPAYGGAVEAFLKKVVTPIYKIIEMEAERSKTIKSKHSHWRNYDDLNEYFWSRDCFRLGWPMRADADFFKTPNFSLAPRDQMNEENRPAGSDHWMGKVNFVEIRSFWHIFRSFDRMWSFLIISLQAMVIIAWNGGTPSDIFDAGVLKQVLSIFITAAVLKLGQAILDIVLSWKARKGMPLVVKLRYILKLLSAAAWVVVLPVTYAYTLENPTGLARTIKSWLGDGRKQPSLYILAVAVYLAPNMLAATMFLFPVLRRALERSNLKVITFMMWWSQPRLFVGRGMHEGAFSLFKYTMFWVLLLATKLIVSFYVEIKPLVQPTKDIMKQPITTFEWHEFFPHAKNNIGVVIALWAPIILVYFMDTQIWYAIFSTLVGGIYGACRRLGEIRTLGMLRSRFESLPKAFNDRLIPNDSNKRRGLRSAFSSKSSQKPEDDKEKEKIAAKFAQIWNLIITSFRAEDLIDNREKDLLLVPYCKDREMDIIQWPPFLLASKIPIALDMAADSGGKDRDLKKRMKSDPYFTYAIKECYASFKNIINTLVVGRERLFIEKIFKVVDDHIEQDILIKELHMSNLPTLSKKFIELLDILQKNNKEDQGQVIILFQDMLEVVTRDIMDDQLSGLLETVHGGNSRRHEGITPLDQQDQLFTKAIEFPVKESHAWTEKIKRLYLLLTVKESAMDVPTNLDARRRISFFANSLFMEMPRAPKVRHMLPFSVLTPYYKEGVLFSSQALEDQNEDGVSVLFYLQKIYPDEWKNFLERVECKTEEELRETEQSGDELRLWASYRGQTLTRTVRGMMYYRQALVLQSFLDMAREEDLMEGFRAADILSDESPLLTQCKAIADMKFTYVVSCQQYGIQKRSGDQRAQDILRLMTTYPSLRVAYIDEVEETSTERSKKIEKVYYSALVKAAVTKPDDPGQKLDQDIYRIKLPGNAMLGEGKPENQNHAIIFTRGEGLQTIDMNQEHYMEETLKMRNLLQEFTKKHDGVRYPSILGVREHIFTGSVSSLAWFMSNQETSFVTIGQRVLANPLRVRFHYGHPDIFDRLFHLTRGGVSKASKIINLSEDIFAGFNSTLREGNVTHHEYMQVGKGRDVGLNQISLFEAKIAYGNGEQTLSRDVYRLGHRFDFFRMLSCYYTTIGFYFSTMITVWTVYVFLYGRLYLVLSGLDKGLTTGKRFRHNDPLQVALASQSFVQLGFLMALPMMMEIGLERGFRTALSDFILMQLQLASVFFTFSLGTKTHYYGKTLLHGGAEYRATGRGFVVFHAKFAENYRLYSRSHFVKGIELMILLIVYEIFGQSYRGAIAYIFITFSMWFMVVTWLFAPFLFNPSGFEWQKIVDDWTDWNKWISNRGGIGVSTEKSWESWWEKEHEPLKYSGKRGTVLEIVLAARFFIYQYGLVYHLNIIHTKSVLVYCLSWVVIFLILAVMKAVSVGRRKFSAEFQLVFRLIKGLIFITFISIIIILIAIPHMTVQDIFVCILAFMPTGWGLLLVAQALKPAIVKLQLWGSIRALARGYEIIMGLLLFTPIAFLAWFPFVSEFQTRMLFNQAFSRGLQISRILGGHKKDRAARNKE

SEQ ID NO: 5313 - protein, 1952 aa, Sorghum bicolor
MASSSGGGGGRRLAPGGDASPASAGARRIYRTQTAGNLGDSIFDSEVVPSSLVEIAPILRVANEVEASNPRVAYLCRFYAFEKAHRLDPTSSGRGVRQFKTALLQRLERENDPTLKGRVKQSDAREMQSFYQHYYKKYIQALQNAADKADRAQLTKAYQTAAVLFEVLKAVNVSQKIEVDQSILETHNQVEEKKKLYLPYNILPLDPDSANQAIMRYPEIQAAFHALRNTRGLPWPKEHDKKPDADLLAWLQAMFGFQKDNVSNQREHLILLLANVHIRQIPKPEQQPKLDDRALDTVMKKLFKNYKRWCKYLGRKSSLWLPTIQQEVQQRKLLYMGLYLLIWGEAANLRFMPECLCYIYHHMAFELYGMLAGNVSPTTGENVKPAYGGEEEAFLKRVVTPIYKVIEKEVERSKTMKSKHSHWRNYDDLNEYFWSRDCFRLGWPMRSDADFFKTPNVSLHHLDGEDRPVGNGNWMGKVNFVEIRSFWHIFRSFDRMWSFLILSLQAMIIIAWNGGTPSDIFDRGVFKQVLSIFITAAILKLGQAILDIILSWKARRNMSLVVKLRYILKLLSAAAWVVILPVTYAYTWENPTGLARTIKSWLGDGQNQPSLYILAVVIYLAPNLLSATLFLFPVIRRALERSNLRVVTFIMWWSQPRLFVGRGMHEGAFSLFKYTMFWVLLLATKLVVSFYVEIKPLVQPTKDIMKEPIRTFKWHEFFPHANNNIGVVIALWAPIILVYFMDTQIWYAIFSTLIGGVYGACRRLGEIRTLGMLRSRFESLPKAFNQCLIPSDTSKRRGFRAAFSKPSKTPEDTKEEEKIAARFAQIWNLIITSFREEDLIDDREKDLLLVPYCKDRDMDIIQWPPFLLASKIPIALDMAADSGGKDRDLKKRMKSDPYFTYAIKECYASFKNIIYALVISSRERGFIQKIFDMVDEHITEETLIKELNMSNLPTLSKKFIELLDLLESNNKEEQGQVIILFQDMLEVVTRDIMVDQLSDLLESIHGPNNKRSEGMMPLDQQVQLFTKAIDFPVKKTQAWNEKIKRLRLLLTVKESAMDVPTNLDARRRISFFANSLFMSMPDAPKVRQMLPFSVLTPYYKEDVLFSSQALGEQNEDGVSILFYLQKIYPDEWKNFLERVHCESEDQLHETEQSEEQLRLWASYRGQTLTRTVRGMMYYRQALVLQAFLDMARDDDLMEGFRAADLLSESDESQLLTQCKAIADMKFTYVVSCQQYGIQKRSGDPHAQDILRLMTTYPSLRVAYIDEVEEPSKDRNKKIEKVYYSALVKAAVTKPDDPGQKLDQDIYRIKLPGNAMLGEGKPENQNHAIIFTRGEGLQTIDMNQEHYMEETLKMRNLLQEFLKKHDGVRYPSILGVREHIFTGSVSSLAWFMSNQETSFVTIGQRVLANPLRVRFHYGHPDIFDRLFHLTRGGVSKASKIINLSEDIFAGFNSTLREGNVTHHEYMQVGKGRDVGLNQISLFEAKIANGNGEQTLSRDVYRLGHRFDFFRMLSCYYTTIGFYFSTMITVWTVYVFLYGRLYLVLSGLDEALATGKRFIHNEPLQVALASQSFVQLGFLMALPMMMEIGLERGFRTALSDFVLMQLQLASVFFTFSLGTKTHYYGTTLLHGGAEYRATGRGFVVFHAKFAENYRLYSRSHFVKGIELMILLIVYEIFGQSYRGAIAYIFITISMWFMVVTWLFAPFLFNPSGFEWQKIVDDWTDWNKWISNRGGIGVPPEKSWESWWEKEQEPLRHSGKRGTVLEIVLALRFFIYQYGLVYHLNITTHTKSVLVYCISWVIIFVILLVMKTVSVGRRKFSAEFQLVFRLIKGLIFITFISIIIILIAIPHMTVQDIFVCILAFMPTGWGLLLIAQTMRSAISHMGLWGSVKALARGYEIIMGLLLFTPIAFLAWFPFVSEFQTRMLFNQAFSRGLQISRILGGHKKDRAARNKE

SEQ ID NO: 5314 - protein, 1942 aa, Sorghum bicolor
MASSSGGGGGRRLAPGGDASPASAGARRIYRTQTAGNLGDSIFDSEVVPSSLVEIAPILRVANEVEASNPRVAYLCRFYAFEKAHRLDPTSSGRGVRQFKTALLQRLERENDPTLKGRVKQSDAREMQSFYQHYYKKYIQALQNAADKADRAQLTKAYQTAAVLFEVLKAVNVSQKIEVDQSILETHNQVEEKKKLYLPYNILPLDPDSANQAIMRYPEIQAAFHALRNTRGLPWPKEHDKKPDADLLAWLQAMFGFQKDNVSNQREHLILLLANVHIRQIPKPEQQPKLDDRALDTVMKKLFKNYKRWCKYLGRKSSLWLPTIQQEVQQRKLLYMGLYLLIWGEAANLRFMPECLCYIYHHMAFELYGMLAGNVSPTTGENVKPAYGGEEEAFLKRVVTPIYKVIEKEVERSKTMKSKHSHWRNYDDLNEYFWSRDCFRLGWPMRSDADFFKTPNVSLHHLDGEDRPVGNGNWMGKVNFVEIRSFWHIFRSFDRMWSFLILSLQAMIIIAWNGGTPSDIFDRGVFKQVLSIFITAAILKLGQAILDIILSWKARRNMSLVVKLRYILKLLSAAAWVVILPVTYAYTWENPTGLARTIKSWLGDGQNQPSLYILAVVIYLAPNLLSATLFLFPVIRRALERSNLRVVTFIMWWSQPRLFVGRGMHEGAFSLFKYTMFWVLLLATKLVVSFYVEIKPLVQPTKDIMKEPIRTFKWHEFFPHANNNIGVVIALWAPIILVYFMDTQIWYAIFSTLIGGVYGACRRLGEIRTLGMLRSRFESLPKAFNQCLIPSDTSKRRGFRAAFSKPSKTPEDTKEEEKIAARFAQIWNLIITSFREEDLIDDREKDLLLVPYCKDRDMDIIQWPPFLLASKIPIALDMAADSGGKDRDLKKRMKSDPYFTYAIKECYASFKNIIYALVISSRERGFIQKIFDMVDEHITEETLIKELNMSNLPTLSKKFIELLDLLESNNKEEQGQVIILFQDMLEVVTRDIMVDQLSDLLESIHGPNNKRSEGMMPLDQQVQLFTKAIDFPIKRLRLLLTVKESAMDVPTNLDARRRISFFANSLFMSMPDAPKVRQMLPFSVLTPYYKEDVLFSSQALGEQNEDGVSILFYLQKIYPDEWKNFLERVHCESEDQLHETEQSEEQLRLWASYRGQTLTRTVRGMMYYRQALVLQAFLDMARDDDLMEGFRAADLLSESDESQLLTQCKAIADMKFTYVVSCQQYGIQKRSGDPHAQDILRLMTTYPSLRVAYIDEVEEPSKDRNKKIEKVYYSALVKAAVTKPDDPGQKLDQDIYRIKLPGNAMLGEGKPENQNHAIIFTRGEGLQTIDMNQEHYMEETLKMRNLLQEFLKKHDGVRYPSILGVREHIFTGSVSSLAWFMSNQETSFVTIGQRVLANPLRVRFHYGHPDIFDRLFHLTRGGVSKASKIINLSEDIFAGFNSTLREGNVTHHEYMQVGKGRDVGLNQISLFEAKIANGNGEQTLSRDVYRLGHRFDFFRMLSCYYTTIGFYFSTMITVWTVYVFLYGRLYLVLSGLDEALATGKRFIHNEPLQVALASQSFVQLGFLMALPMMMEIGLERGFRTALSDFVLMQLQLASVFFTFSLGTKTHYYGTTLLHGGAEYRATGRGFVVFHAKFAENYRLYSRSHFVKGIELMILLIVYEIFGQSYRGAIAYIFITISMWFMVVTWLFAPFLFNPSGFEWQKIVDDWTDWNKWISNRGGIGVPPEKSWESWWEKEQEPLRHSGKRGTVLEIVLALRFFIYQYGLVYHLNITTHTKSVLVYCISWVIIFVILLVMKTVSVGRRKFSAEFQLVFRLIKGLIFITFISIIIILIAIPHMTVQDIFVCILAFMPTGWGLLLIAQTMRSAISHMGLWGSVKALARGYEIIMGLLLFTPIAFLAWFPFVSEFQTRMLFNQAFSRGLQISRILGGHKKDRAARNKE

SEQ ID NO: 5315 - protein, 1872 aa, Oryza sativa
MAAPGGARRPDFSSAASPSPSPAGAAGRRLLRTQTVGNLGESIFDSEVVPSSLVEIAPILRVANEVEATNPRVAYLCRFYAFEKAHRLDPTSNGRGVRQFKTALLQRLERENDPTLKGRVHQSDAREMQRFYREYYKKYIQALQNAADKADRALLTKAYQTAAVLFEVLKAVNVSQSVEVDQAILDTHNKVEEKKKLYVPYNILPLDPESTYQPIMQYPEIQAAVNALRNIRGLPWPKEHEKKPDEKKTGKDLLDWLQAMFGFQVVIHFLVKLSMLTSQHVLCPGNVHSLTKDNVSNQREHLILLLANVHIRQSPKTEQQAKLDDRALDAVMKKLFKNYKKWCKYLGRKSSLWLPTIQQEVQQRKLLYMGLYLLIWGEAANLRFMPECLCYIYHHIMEALLNSINYIEMAFELYGMLAGNVSPMTGENVKPAYGGDEEAFLMKVVTPIYKVIEKEAERSKTIKSKHSHWRNYDDLNEYFWSVDCFRLGWPMRADADFFKTPEDAYPSRLNGIIGMDYISSLVLQCNAKKKKYLLGVLILWVPISRLVANAGEQIRRRFLESSNVKVITFIMWWSQPRLFVGRGMHEGAFSLFKYTMFWVLLLAMKLTIKPLVQPTKDIMKEPIRDFQWHEFFPRANNNIGVVIALWAPIILVYFMDTQIWYALFSTLIGGIYGAYRRLGEIRTLGMLRSRFESLPEAFNEHLIPSDSHKSKGLRAAFTGKPSKTSGDEQEKEKIAARFAQMWNLIITSFREEDLIDNREMDLLLVPYCKDRELNIFQWPPFLLASKIPIALDMAADSGGKDRDLKKRMGSDPYFSYAIRECYGSFKNIINTLVFGQREKIVIQQIFTIVDEHIEGGSLIKDLNMRSLPALSKKFIELLELLQKNKEEDLGQVVILFQDMLEVVTRDIMDEQDQLGGLLDSVHGGNRKHEGMTSLDQQDQLFTKAIRFPVEESNAWTEKIKRLHLLLTVKESAMDVPTNLDARRRISFFANSLFMEMPNAPKVRHMLPFSVLTPYYKEDVLFSSHNLEEPNEDGVSILFYLQKIYPDEWKNFLDRVDRKSEEELREDETLEEELRLWASYRGQTLTRTVRGMMYYRKALELQAFLDMAKDDDLMEGYRATELMSEDSQLMTQCKAIADMKFTYVVSCQQYGIQKRSGEACAHDILRLMTVRAVVIVYPSLRVAYIDEVEAPSQDRNKKTDKVYYSALVKASVTKPNEPGQSLDQVIYKIKLPGNAILGEGKPENQNHAIIFTRGECLQTIDMNQEHYMEEALKMRNLLDEFLKKHDGVRYPSILGVREHIFTGSVSSLAWFMSNQETSFVTIGQRVLANPLRVRFHYGHPDIFDRLFHLTRGGVSKASKIINLSEDIFAGFNSTLREGNVTHHEYMQVGKGRDVGLNQIALFEAKIANGNGEQTLSRDIYRLGHRFDFFRMLSCYYTTIGFYFSTMITVWTVYVFLYGRLYLVLSGLDQALATGKKFVHNAPLQVALASESFVQLGFLMALPMMMEIGLERGFRTALSDFVLMQLQLASVFFTFSLGTKTHYYGRTLLHGGAEYRATGRGFVVFHAKFADNYRLYSRSHFVKGIELMILLVVYEIFGQSYRGAITYIFITVSMWFMVGTWLFAPFLFNPSGFEWQKIVDDWTDWNKWISNRGGIGVAPTKSWESWWEKEQEPLRYSGKRGTILEILLALRFFVYQYGLVYHLNITKHTRSVLVYCFSWVVIFVILLVMKTVSVGRRRFSAEFQLVFRLIKGLIFITFVAIVVILIAIPHMTVLDIFVCILAFMPTGWGLLLIAQAIKPAVQAIGLWGSIKALARGYEILMGLLLFTPIAFLAWFPFVSEFQTRMLFNQAFSRGLQISRILGGHKKDRSTRNKE

SEQ ID NO: 5316 - protein, 1125 aa, Secale cereale
MWNLIITSFREEDLIDNREMDLLLVPYCKDRELDIFQWPPFLLASKIPIALDMAADSGGNYRDLNKRMKSDPYFSYAIRECYASFKNIINTLVFGQREKIVMQEIFEVVDKHIAEETLIKDLNMRSLPALSKKLIELLELLQKNKLEDLGQVVILFQDMLEVVTKDIMEEQELSSVLDSIHGGNAKKHEGMTPLDQQDQLFTKAIKFPVEASNAWTEKIKRLHLLLTVKESAMDVPTNLDARRRISFFANSLFMDMPNAPKVRNMLPFSVLTPYYKEDVLFSSDNLEEANEDGITILFYLQKIYPDEWKNFLERVNRTEEEARDDDTIEDELRLWASYRGQTLTRTVRGMMYYRKALELQAFLDNAKDDDLMKGYREIADMKESELMTECKALADMKFTYVVSCQQYGIQKRSGDPCAHDILRLMTTYPSFRVAYIDEVEAPSQDRNKKTDKVYYSVLVKAAVTKSDDPGQSLDQVIYKIKLPGNAILGEGKPENQNHAIIFTRGECLQTIDMNQEHYMEEALKMRNLLEEFLEKHDGVRYPSILGVREHIFTGSVSSLAWFMSNQETSFVTIGQRVLANPLRVRFHYGHPDIFDRLFHLTRGGISKASKIINLSEDIFAGFNSTLREGNVTHHEYMQVGKGRDVGLNQISLFEAKIANGNGEQTLSRDIYRLGHRFDFFRMLSCYYTTIGFYFSTMITVWTVYAFLYGRLYLVLSGLDAALATGKRFVHNTPLQVALASESFVQLGFLMALPMMMEIGLERGFRTALSDFVLMQLQLASVFFTFSLGTKTHYYGRTLLHGGAEYRATGRGFVVFHAKFAENYRLYSRSHFVKGIELMILLVVYEIFGQSYRGAITYIFITVSMWFMVGTWLFAPFLFNPSGFEWQKIVDDWTDWNKWISNRGGIGVAPEKSWESWWDKEQGPLRHSGKRGTILEILLALRFFIYQYGLVYHLNITKQYNQSVLVYGFSWVVILVMLLVMKTVSVGRRRFSAEFQLVFRLIKGLIFITFISILIILTAIAHMTVLDIFVCILAFMPTGWGLLLIAQAMKPVVEMVGLWGSVKALARGYEILMGLLLFTPIAFLAWFPFVSEFQTRMLFNQAFSRGLQISRILGGHKKDRATRNKE

SEQ ID NO: 5317 - protein, 1143 aa, Secale cereale
MASSSGRRPGAGPGGGEPSSSGAAATPASGGRRILRTQTAGNLGESIFDSEVVPSSLVEIAPILRVANEVEASNPRVAYLCRFYAFEKAHRLDPTSSGRGVRQFKTALLQRLERENDPTLKGRVKQSDAREMQSFYQHYYKKYIQALQNAADKADRAQLTKAYQTAAVLFEVLKAVNVSQKIEVDQAILETHNQVEEKKKLYLPYNILPLDPDSAANQAIMRYPEIQASFHALRNTRGLPWPKDHEKKDDADLLEWLQALFGFQKDNVSNQREHLILLLANVHIREMSKPDQQSKLDDHALDIVMKKLFKNYKRWCKYLGRKSSLWLPTIQQEVQQRKLLYMGLYLLIWGEAANLRFMPECLCYIYHHMAFELYGMLAGNVSPTTGENVKPAYGGAEEAFLKKVVTPIYKIIEMEAERSKTIKSKHSHWRNYDDLNEYFWSRDCFRLGWPMRADADFFKTPNFVLNTRDQANGENRPIRNDHWMGKVNFVEIRSFWHIFRSFDRMWSFLILSLQAMVIVAWNGGTPGDIFDAGVFKQVLSIFITAAVMKMGQAILDIVLSWKARKSMSLAVKLRYILKLLSGAAWVVVLPVTYAYTSDNPTGLNRTIKSWFGDGRNQPSLYILAVVIYLSPNMLAATLFIFPILRRFLEKSNLKVVALIMWWSQPRLFVGRGMHEGAFSLFKYTMFWVVLLATKLVVSFYVEIRPLVQPTKDIMKVPITTFQWHEFFPHAKNNVGVVIALWAPIILVYFMDTQIWYAIFSTLVGGIYGACRRLGEIRTLGMLRSRFESLPKAFNDHLIPNDSKRRGFRSAFSSKPYKKPEDGKEEDKIAARFAQIWNLIITSFRQEDLIDNREKDLLLVPYCKDREMDMIQWPPFLLASKIPIALDMAADSGGKDRDLKKRMSSDPYFTYAIKECYASFKNVIYALVVGPRERDVIQKIFKVVDDLVAADTLIKDLHMSNLPTLSKKFIELLVILQKNNKEDLGQVIILFQDMLEVVTRDIMEDQLTELLEPVHGGNNRKHEGITPLDQQEQEQLFTKAVEFEFPVKASDAWKEKIKRLHLLLTVKESAMDVPTNLDARRRISFFANSLFMDMPKAPKVRNMLPFSVLTPYYKEDVLFSSQALEEENEDGVSILFYLQKILPR

SEQ ID NO: 5318 - protein, 409 aa, Triticum aestivum
ALATAPAPSRPGLPPPTRCSHLRRPKALATSKLPRRVIAALHMDGARAAPLRCTPAETDAVATTSDQTETAAAVEATEQGNNGAPAADAPAASIEGLDGIKIRRRPVTGPSVHHVGPFQFRLENEGNTPRNILEKIVWNKDVEIWQMKEKMPLYRLKGPLDNAPPARDFVAALKASYDRTALPALIAEVKKASPSRGVLRENFDPVEIAQAYEKNGAACLSVLTDSKFFQGSFDYLEAIRNAGVKCPLLCKEFIIDAWQLYYARSKGADAVLLIAAILPDRDISYMLKICKILGMAALVEVHDEREIDRVIGIDGIQLIGINNRNLETFEVDISNTKNLLEGERGQLIAQKDIIVVGESGLFTPDHVSFVQDAGVKAILVGESLIKQEDPGKAIAGLFGKDISPVSSAV

SEQ ID NO: 5319 - protein, 407 aa, Triticum aestivum
ALATAPAPSRPGLPPPTRCSHLRRPKALAASKLPRRVIAALHMDGARAAPLRCTPAETDAAATTSDQTETAVEATEQGNNGAPAADAPASSIEGLDGIKIRRRPVTGPSVHHVGPFQFRLENVGNTPRNILEKIVWNKDVEIWQMKEKMPLYRLKGPLDNAPPARDFVAALKASYDRTALPALIAEVKKASPSRGGLRENFDPGEIAQAYEKNGAACLSVLTDSKFFQGSFDYLEAIRNAGVKCPLLCKEFIIDAWQLYYARSKGADAVLLIAAILPDRDISYMLKICKILGMAALVEVHDEREIDRVIGIDGIQLIGINNRNLETFEVDISNTKKLLEGERGQLIAQKDIIVVGESGLFTPDHVSFVQDAGVKAILVGESLIKQEDPGKAIAGLFGKDISPVSSAV

SEQ ID NO: 5320 - protein, 403 aa, Pseudoroegneria spicata
  misc_feature (2)..(3): Xaa can be any naturally occurring amino acid
AXXRPGLPPPTRRSHLRRPKALATSKLPRRVIAALHMDGARAAPLRCTPAETDAVATTSDQAETAEAAVEVTEQGNGAPAADAPVASIEGLDGIKIRRRPVTGPSVHHVGPFQFRLENEGNTPRNILEKIVWNKDVEIWQMKEKMPLYRLKGPLDNAPPARDFVAALKASYDRTALPALIAEVKKASPSRGVLRENFDPVEIAQAYEKNGAACLSVLTDSKFFQGSFDYLEAIRNAGVKCPLLCKEFIIDAWQLYYARSKGADAVLLIAAILPDRDISYMLKICKILGMAALVEVHDEREIDRVIGIDGIQLIGINNRNLETFEVDISNTKKLLEGERGQLIAQKNIIVVGESGLFTPDHVLFVQDAGVKAILVGESLIKQEDPGKAITGLFGKDISPMSSAV

SEQ ID NO: 5321 - protein, 326 aa, Secale cereale
MEALATAPAPSRPGLPPPTRCSHLRRPKAPAISKLPRRVIAALHMDRGTPLRCTPAETDAAATTSDQTETAAAVEAAEQGNNGAPAADASAASIEGLDGIKIRRRPVTGPSVHHVGPFQFRLENVGNTPRNILEKIVWNKDVEIWQMKEKMPLYRLKGPLDNAPPARDFVAALKASYDRTALPALIAEVKKASPSRGVLRENFDPVEIAQAYEKNGAACLSVLTDSKFFQGSFDYLEAIRNAGVKCPLLCKEFIIDAWQLYYARSKGADAVLLIAAILPDRDISYMLKICKILGMSALVEVHDEREIDRVIGIDGIQLIGINNRNT

SEQ ID NO: 5322 - protein, 421 aa, Pennisetum glaucum
MEALAIGSAPPRPGLPAPTRYSHLGRPRTLAAARRPLAAAHMDDAAAGGGRPSPAPPRCTRAETDAEVGEVATTTSSHAEAAAAVATEEGGSGSPVEDAAAAGTASIEGVDGIRIRRRPVTGPAVHYVGPFQFRLENEGNTPRNILEKIVWDKDVEVSQMKERRPLYMLKGPLEAAPPPRDFVGALKASYHRTGLPALIAEVKKASPSRGVLREDFDPVQIAQAYEKNGAACLSVLTDGKYFQGSFDNLADIRNAGVQCPLLCKEFIVDAWQLYYARSKGADAVLLIAAVLPDRDIKYMLKICKILGMAALVEVHDEREMDRVLGIDGVQLIGINNRNLETFEVDISNTKKLLEGERGQMIAQKGIIVVGESGLFTPDHISFVQNAGVKAVLVGESLIKQEDPGKAIAGLFGKDISNAGAA

SEQ ID NO: 5323 - protein, 420 aa, Setaria italica
MEALAIGSAPPRPGLPAPTCYSHLRRPRTFAASAAARRPLVAAHMDAAASGGRPSPAPPRCTRAETDSEVGEVATTTSSHAEAAVATEEGDSGSPVEDAAAAGASIEGVDGIRIRRRPVTGPAVHYVGPFQFRLENEGNTPRNILEKIVWDKDVEVSQMKERRPLYMLKGPLEAAPPARDFVGALKASYDRTGLPALIAEVKKASPSRGVLREDFDPVQVAQAYEKNGAACLSVLTDKKYFQGSFDNLAAIRNAGVQCPLLCKEFIVDAWQLYYARSKGADAVLLIAAVLPDLDIKYMLKICKILGMAALVEVHDEREMDRVLGIDGVQLIGINNRNLETFEVDISNTKKLLEGERGKMIAQKDIIVVGESGLFTPDHISFVQNAGGKAVLVGESLIKQEDPGKAIAGLFGKDISNAGAA

SEQ ID NO: 5324 - protein, 405 aa, Hordeum vulgare
APAPSRPGLPPPTRRSHLRRPKTLATSKLPRRVTAALPMDRAAPLRCTPAETDAAATTSDQAETAAAAAAEATEQGNNGGPAGNAPAASIEGLDGIKIRRRPVTGPSVHHVGPFQFRLENEGNTPRNILEKIVWNKDVEIWQMKEKMPLYRLKGPLDNAPPARDFVAALKASYNRTALPALIAEVKKASPSRGVLRENFDPVEIAQAYEKNGAACLSVLTDSKFFQGSFDYLEAIRNAGVKCPLLCKEFIIDAWQLYYARSKGADAVLLIAAILPDRDISYMLKICKILGMAALVEVHDEREIDRVIGIDGIQLIGINNRNLETFEVDISNTKKLLEGERGQLIAQKDIIVVGESGLFTPDHVSFVQDAGVKAILVGESLIKQDDPGKAIAGLFGKDISPVSSAA

SEQ ID NO: 5325 - protein, 411 aa, Panicum virgatum
MEALAVGSAPPRPGLAAPTRYPHLRRPRTLAAARCRPLAAAPMEADGGGRPSPAPARCASAETESEVDEAATSSPAAEAAAAGATEQGGNGSPVASIEGVDGIRIRRRPVTGPAVHYVGPFQFRLENEGNTPRNILEKIVWDKDVEVSQMKERRPLYMLKGALEAAPPARDFVGALKASYDRTGLPALIAEVKKASPSRGVLREDFDPVQIAQAYEKNGAACLSVLTDEKYFQGSFNYLEAIRNAGVQCPLLCKEFIVDAWQLYYARSKGADAVLLIAAVLPDRDINYMLKICKILGMAALVEVHDEREMDRVLGINGVQLIGINNRNLETFEVDISNTKKLLEGERGQLIAQKDVIVVGESGLFTPDHISFVQNAGVKAVLVGESLIKQEDPGKAIAGLFGKDISHAVAS

SEQ ID NO: 5326 - protein, 422 aa, Sorghum bicolor
MEALAIGSAPPRPGLAALARYSHLRRPGTVTGTLVTAARRPVTAASMDAAAGGRPSPAPIRCTSAETDAEVEVDEVATSSHAAGATTDTEQGGNGSPVAGAADSAEVVPGVDGIRIRRRPVTGPAVHYVGPFQFRLENEGNTPRNILEKIIWDKDVEVSQMKERRPLYMLKGPLEAAPPARDFVGALKASYDRTGLPALIAEVKKASPSRGVIRENFDPVQIAQAYEKNGAACLSVLTDEKYFQGSFNNLEAIRNAGVQCPLLCKEFIVDAWQLYYARSKGADAVLLIAAVLPDRDIKYMLKICKILGMAALVEVHDEMEMDRVLGIDGVQLIGINNRNLETFEVDITNTKKLLEGERGQIIAQKDVIVVGESGLFTPDDISFVQNAGVKAVLVGESLIKQEDPGKAIAGLFGKDISHAGAT

SEQ ID NO: 5327 - protein, 417 aa, Zea mays
MEALAIGSAPRRPGARYSQLRRPGTLAVTTTATVACRPLTAPSMDAAVGRPSRAPIRCTSAETDSVDEVATSSHAAEANAGGTTEQEGNGSPVAAAAAYSPVVAGVDGIRIRRRPVTGPAVHYVGPFQFRLENEGNTPRNILEKIIWNKDVEVSQMKERRPLYMLKGPLEAAPPARDFVGALKASYDRTGLPALIAEVKKASPSRGVIRENFDPVQIAQAYEKNGAACLSVLTDEKYFQGSFYNLEAIRNAGVQCPLLCKEFIIDAWQLYYARSKGADAVLLIAAVLPDRDIKYMLKICKILGMAALVEVHDEREMDRVLGIDGVQLIGINNRNLETFEVDITNTKKLLEGERGQVIAQKDVIVVGESALFTPDDISFVQNAGVKAVLVGESLIKQEDPGKAIAGLFGKDISHAGAT

SEQ ID NO: 5328 - protein, 419 aa, Oryza sativa
MEALAIGSAPPRPPGLALPPLTRHHHLLLHRSKTLAPRRFVAAAPMDAAAAAAGRGGPAPPRCARAETDSEDAVATTSSPHSAEAAGAAEQGNGAPAPVADAADVEGVDGIRIRRRPVTGPPVHYVGPFQFRLENEGNTPRNILERIVWDKEAEVSQMKERRPLYMLKGPLENAPPVRDFVGVLKASFDRTGLPALIAEVKKASPSRGVLREDFEPVQIAQTYEKNGAACLSVLTDAKYFQGSFDYLDAIRNAGVQCPLLCKEFIVDAWQLYYARLKGADAVLLIAAVLPDLDIKYMLKICKILGMAALVEVHDEREMDRVLGIDGVQLIGINNRNLETFQVDISNTKNLLEGERGQTIAQKGIIVVGESGLFTPDHISFVQNAGVKAVLVGESLIKQEDPGKAIAGLFGKDISPVSAA

SEQ ID NO: 5329 - protein, 374 aa, Oryza sativa
MDAAAAAAGRGGPAPPRCARAETDSEDAVATTSSPHSAEAAGAAEQGNGAPAPVADAADVEGVDGIRIRRRPVTGPPVHYVGPFQFRLENEGNTPRNILERIVWDKEAEVSQMKERRPLYMLKGPLENAPPVRDFVGVLKASFDRTGLPALIAEVKKASPSRGVLREDFEPVQIAQTYEKNGAACLSVLTDAKYFQGSFDYLDAIRNAGVQCPLLCKEFIVDAWQLYYARLKGADAVLLIAAVLPDLDIKYMLKICKILGMAALVEVHDEREMDRVLGIDGVQLIGINNRNLETFQVDISNTKNLLEGERGQTIAQKGIIVVGESGLFTPDHISFVQNAGVKAVLVGESLIKQEDPGKAIAGLFGKDISPVSAA

SEQ ID NO: 5330 - protein, 674 aa, Secale cereale
WGELSRAVLRPGVPFAVHRMLYYGCYVGSPSTTPPAWTPDSEEAALTNVGRVLEARGSEIIGQAYKDPVTSFRDFHKFSNENPEAYWKMVFEEMGITFSVEPSCILRDSDAYPGGEWLPGAVLNAAANCLTAKPGRTSSDVAIVWRDEGKDSEALNFVTVEELRKKVCLVANALDALNLAEGSAIAIDMPMNVNAVVIYLAIVLAGYIVVSIADSFAAPAISTRLKISEAKAIFTQDCILRDDKELPLYSRVVEAKAPMAIVIPARGSTPIKGLRTDDLSWEDFLGRADRTKAGIYTAVEQPAYQFSNILFSSGTTGEPKAIPWTHLTPLKAAADGWCHMDIRKGDVVAWPTNLGWMMGPWLVYASLLNGASMALYNGSPNSSGFAKFVQDAKVTMLGVVPSIVRTWKNTDCTAGFDWSNIRCFSSTGEASSVDDYLWLMGRACYKPVIEYCGGTEIGGGFITGSLLQPQALSAFSTPAMGCNLFILDSNGNPLPHDSAGIGELALDPTLFGSSTTLLNADHHEVYFSGMPEWNAKVLRRHGDEFERTADGYYRAHGRADDTMNLGGIKVSSIEIERICNRVNDAILETAAIGVPPVGGGPEQLTIAVVFKDQSPQAEDLNQLKLMFNSALKKLNPLFKVSSVVVVSSLPRTASNKVMRRVLRKEFTQAKHSKI

SEQ ID NO: 5331 - protein, 587 aa, Oryza sativa
MVFEEMGITFSVEPSCILRENDAYPGGEWLPGAVLNAAANCLTAKPGRSSDDVAIVWRDEGKDSEPLNFVTLEELRKKVCLVANALDALNLAKGSAIAIDMPMNVNAVVIYLAIVLAGYVVVSIADSFAAPAISMRLKISEAKAIFTQDYILRDDKELPLYSRVVEAKAPMTIVIPVRGSTPIKGLRADDLSWEDFLAKVNHAKADNYTAVEQPAYAFTNILFSSGTTGEPKAIPWTHLTPLKSAADGWCHMDIRRGDVVAWPTNLGWMMGPWLVYASLLNGASMALYNGSLNSSGFAKFVQDAKVTMLGLVPSIARSWKSTDCTAGFDWSTIRCFSSSGEASSVDDYLWLMGRVCYKPVIEYCGGTEIGGGFVAGSLLQPQALSAFSTPAMGCNLFILDNNGNPLPQDSVGTGELALDPTFLGASTTLLNADHHEVYFSGMPEWNGKVLRRHGDEFERTPDGYYRAHGRADDTMNLGGIKVSSIEIERICNRVNDAILETAAIGVPPLGGGPEQLTIAVVFKDQSSQTEDLNQLKLAFNTALKKLNPLFKVSSVVVVPSLPRTASNKVMRRVLRKEFTQQPKHSKI

SEQ ID NO: 5332 - protein, 726 aa, Setaria italica
MAAASHKPLGAITADDLAAAAPGVDAAALHAALRRALDSRAGAGDPAAVWGELCRSLLRPDVPFAVHRMLYYGCFAGFPSPTPPAWTPDPKEAALTNVGRVMEVRGRELLGDAYKDPITSFPDLYKFSNENPEAYWRMVFEDMGVEFSVEPSCIWRESDAYPGGEWLPGAELNAAANCLNAKPGRSSQDVAIVWRDEGKDSEPLNFMTLEELRKKVCLVANALDALDLPKGSAIAIDMPMNVNAVVIYLAIVLAGYVVVSIADSFAAPAISTRLKISEAKAIFTQDYILRDDKELPLYSRVVEAKAPMAIVIPVRGSLPIKGLRVSDLSWQDFLGRVNDTKVENYAAVKQPAYAFTNILFSSGTTGEPKAIPWTHITPLKAAADGWCHMDIRKGDVVVWPTNLGWMMGPWLVYASLLNGASMALYNGSPNSSGFAKFVQDAKVTMLGLVPSIARTWKNTDCTAGFDWSAIRCFSSSGEASSVDDYLWLMGRACYKPVIEYCGGTEIGGGFVAGSLLQPQALSAFSTPAMGCNLFILDGSGNPLPQDSVGIGELALDPVLFGSSTTLLNADHQEVYFNGMPEWNGKVLRRHGDEFERTCDGYYRAHGRADDTMNLGGIKVSSIEIERICNRVNDAILETAAIGVPPIGGGPEQLTIAVVLKDQSSQVEDLNQLKLAFNVALKKLNPLFKVSSVVVVPSLPRTASNKVMRRVLRKEFTQAAQAKKSKI

SEQ ID NO: 5333 - protein, 731 aa, Oryza sativa
MGHAAAAAAAAHVPLGAITVDDLLAAGVAGGAAAELHEAVRRAVGARGGDGDAAAVWGELCRAALRPGVPFAVHRMLYYGCFAGFPSATPPAWTPDPEEAVLTNVGRVLEARGREFLGDKYKDPIASFTDFHKFSIENPEAYWKMVFEEMGITFSVEPSCILRENDAYPGGEWLPGAVLNAAANCLTAKPGRSSDDVAIVWRDEGKDSEPLNFVTLEELRKKVCLVANALDALNLAKGSAIAIDMPMNVNAVVIYLAIVLAGYVVVSIADSFAAPAISMRLKISEAKAIFTQDYILRDDKELPLYSRVVEAKAPMTIVIPVRGSTPIKGLRADDLSWEDFLAKVNHAKADNYTAVEQPAYAFTNILFSSGTTGEPKAIPWTHLTPLKSAADGWCHMDIRRGDVVAWPTNLGWMMGPWLVYASLLNGASMALYNGSLNSSGFAKFVQDAKVTMLGLVPSIARSWKSTDCTAGFDWSTIRCFSSSGEASSVDDYLWLMGRVCYKPVIEYCGGTEIGGGFVAGSLLQPQALSAFSTPAMGCNLFILDNNGNPLPQDSVGTGELALDPTFLGASTTLLNADHHEVYFSGMPEWNGKVLRRHGDEFERTPDGYYRAHGRADDTMNLGGIKVSSIEIERICNRVNDAILETAAIGVPPLGGGPEQLTIAVVFKDQSSQTEDLNQLKLAFNTALKKLNPLFKVSSVVVVPSLPRTASNKVMRRVLRKEFTQQPKHSKI

SEQ ID NO: 5334 - protein, 722 aa, Sorghum bicolor
MAAELHKPLGAITADDLAAAAPGCDATALHSALRRALDSHGPAAVWAELCRSVLRPSVPFAVHRMLYYGCFAGFPSPTPPAWTPDPKEAALTNVGRVLEARGRDFIGDAYKDPITSFPDLHKFSNENPETYWKMVFEEMGVQFSVEPSCIWRENAAYPGGEWLPGAELNAAANCLTAKPGRSSDSPAIVWRDEGKDSEPLNFMSLEELRKKVCLVANALDALELPKGSAIAIDMPMDVNAVVIYLAIVLAGYVVVSIADSFAAPAISMRLKISEAKAIFTQDYILRDDKELPLYSRVVEVKAPMAIVIPVRGSLPIKGLRVDDLSWQDFLGRVNNTEAENYIAVKQPADAFTNILFSSGTTGEPKAIPWTHITPLKAAADGWCHMDIRKGDVVAWPTNLGWMMGPWLVYASLLNGASMALYNGSPNSSGFAKFVQDAKVTMLGLVPSIARTWKNTDCTAGLDWSSIRCFSSSGEASSVDDYLWLMGRAGYKPVIEYCGGTEIGGGFVTGSLLQPQALSAFSTPAMGCNLFILDSNGNPLPQDSVGIGELALDPTLFGSSTTLLNADHQEVYFNGMPEWHGKILRRHGDEFERTSDGYYRAHGRADDTMNLGGIKVSSIEIERICNRVHDAIVETAAIGVPPVGGGPEQLTIAVVLKDQSSQLEDWNQLKLAFNVALKKLNPLFKVSSVVVVPSLPRTASNKVMRRVLRKEFSQAAQAKHSKI

SEQ ID NO: 5335 - protein, 720 aa, Panicum virgatum
SHKPLGAITAGDLAAAAPGTDAAALHAALRRALGAGDADPAAVWGELCRSLLRPDAPFAIHRMLYYGCFAGLPSPTPPAWTPDPEEAALTNVGRVMEARGRELLGDAYQDPITSFTDLYKFSNENPEAYWKMVFEDMGVEFSVEPSCIWRESHAYPGGEWLPGAELNAAANCLTAKPGRSSEDVAIVWRDEGKDSEPLNFMTLEELRKKVCHVANALDALDLPKGSAIAIDMPMNVNAVVIYLAIVLAGYVVVSIADSFSAPAISTRLKISEAKAIFTQDYILRDDKELPLYSRVVEAKAPMAVVISARGSLPIKGLRLNDLSWQDFLGRVNDTKVESYAAVNQPAYAFTNILFSSGTTGEPKAIPWTHMTPLKAAADGWCHMDIRKGDVVAWPTNLGWMMGPWLVYASLLNGASMALYNGSPNSSGFAKFVQDSKVTMLGLVPSIARTWKNTDCTAGFDWSSIRCFSSSGEASSVDDYLWLMGRACYKPVIEYCGGTEIGGGFVTGSLLQPQALSAFSTPAMGCNLFILDSSGNPLPQDSVGIGELALDPILFGSSTTLLNADHQEVYFNGMPEWNGKVLRRHGDEFERTCDGYYRAHGRADDTMNLGGIKVSSIEIERICNRANDAILETAAIGVPPIGGGPEQLTIAVVFKDQSTQVEDLNQLKLAFNTALKKLNPLFKVSSVAVVPSLPRTASNKVMRRVLRKEFTQAAQAKISKI

SEQ ID NO: 5336 - protein, 722 aa, Sorghum bicolor
MAAELHKPLGAITADDLAAAAPGCDATALHSALRRALDSHGPAAVWAELCRSVLRPSVPFAVHRMLYYGCFAGFPSPTPPAWTPDPKEAALTNVGRVLEARGRDFIGDAYKDPITSFPDLHKFSNENPETYWKMVFEEMGVQFSVEPSCIWRENAAYPGGEWLPGAELNAAANCLTAKPGRSSDSPAIVWRDEGKDSEPLNFMSLEELRKKSSLVANALDALELPKGSAIAIDMPMDVNAVVIYLAIVLAGYVVVSIADSFAAPAISMRLKISEAKAIFTQDYILRDDKELPLYSRVVEVKAPMAIVIPVRGSLPIKGLRVDDLSWQDFLGRVNNTEAENYIAVKQPADAFTNILFSSGTTGEPKAIPWTHITPLKAAADGWCHMDIRKGDVVAWPTNLGWMMGPWLVYASLLNGASMALYNGSPNSSGFAKFVQDAKVTMLGLVPSIARTWKNTDCTAGLDWSSIRCFSSSGEASSVDDYLWLMGRAGYKPVIEYCGGTEIGGGFVTGSLLQPQALSAFSTPAMGCNLFILDSNGNPLPQDSVGIGELALDPTLFGSSTTLLNADHQEVYFNGMPEWHGKILRRHGDEFERTSDGYYRAHGRADDTMNLGGIKVSSIEIERICNRVHDAIVETAAIGVPPVGGGPEQLTIAVVLKDQSSQLEDWNQLKLAFNVALKKLNPLFKVSSVVVVPSLPRTASNKVMRRVLRKEFSQAAQAKHSKI

SEQ ID NO: 5337 - protein, 728 aa, Pennisetum glaucum
MAAAAAHKPLGAITPGDLAAAAPGADAAALHAALRLVLDESRAGAADPAAVWGELCRSLLRPDVPFAVHRMLYYGCFAGFPYSTPPAWTPDPKEAPLTNVGRVMEARGRELLGDAYKDPITSFPDLYKFSNENPEAYWRMVFEDMGVEFSAEPSCIWRESDAYPGGEWLPGAELNAASNCLSAKPGTSSKDVAIVWRDEGKDSEPLNFVTLEELRKKVCLVANALDALDLPKGSAIAIDMPMNVNAVVIYLAIILAGYVVVSIADSFAAPAISTRLKISEAKAIFTQDYILRDDKELPLYSRVVEAMAPMAIVIPVRGSLPIKGLRVNDLSWQDFLGRVNDTKVENYTAVKQPAYAFTNILFSSGTTGEPKAIPWTHITPLKAAADGWGHMDIRKGDVVAWPTNLGWMMGPWLVYASLLNGASMALYNGSPNSSGFAKFVQDAKVTMLGLVPSIARAWKNTDCTAGFDWSTIRCFSSSGEASSVDDYLWLMGRACYKPVIEYCGGTEIGGGFVTGSLVQPQALSAFSTPAMGCNLFILDGSGNPLPQDSVGIGELALDPVLFGSSTTLLNADHHEVYFNGMPEWNGKILRRHGDEFERTSDGYYRAHGRADDTMNLGGIKVSSIEIERICNRVNDAILETAAIGVPPIGGGPEQLTIAAVLKDQSSQVEDLNQLKLAFNVALKKLNPLFKVSSVVVVPSLPRTASNKVMRRVLRKEFSQAPQAKKSKI

SEQ ID NO: 5338 - protein, 722 aa, Zea mays
MATTLHKPLGAITVDDLAAAAPGSDATALHAALRRALDSHGPTEVWGELCRSVLCPSVPFAVHRMLYYGCFAGFPSPTPPAWTPDPKEAVLTNVGRVLEARGRDFIGDAYKDPITSFPDLHKFSNENPEAYWKMVFEDMGIQFSVEPSCIWRENTAYPGGEWLPGAELNAAVNCLTAKPGRSSDGPAIVWRDEGKDSDPLNFMSLEDLRKKVCLVANAIDALELPKGSAIAIDMPMDVNAVVIYLAIVLAGYVVVSIADSFAAPAISMRLKLSEAKAIFTQDYILRDDKELPLYSRVVEAKAPMAIVIPVRGSLLIKGLRVDDLSWQDFLGRVNYTEAENYTAVNQPAYAFTNILFSSGTTGEPKAIPWTHITPLKAAADGWCHMDIRKGDVVAWPTNLGWMMGPWLVYASLLNGASMALYNGSPNSSGFAKFVQDAKVTMLGLVPSIVRTWKNTDCTAGLDWSSIRCFSSSGEASSVDDYLWLMGRAGYKPVIEYCGGTEIGGGFVTGSMLQPQALSAFSTPAMGCNLFILDSSGNPLPQDSVGIGELALDPTLFGSSTTLLNADHQEVYFNGMPEWHGKILRRHGDEFERTSDGYYRAHGRADDTMNLGGIKVSSIEIERICNRVHDAILETAAIGVPPVGGGPEQLTIAVVLKDQSSQIEDLNQLKLACNMALKKLNPLFKVSSVVIVPSLPRTASNKVMRRVLRKEFSQAAQAKHSKI

SEQ ID NO: 5339 - protein, 166 aa, Panicum virgatum
MAAAAPSLAPSPSPATAPTTAASPKAGDRSKVVPLTAADEVELEEKHVLAVDDSSVDRAVIAKILRSSKYRVTTVDSATRALELLALGLLPDVNMIITDYWMPGMTGYELLKHVKESSKLKEIPVVIMSSENVPNRITRCLEEGAEDFLLKPVRPSDVSRLCSRIR

SEQ ID NO: 5340 - protein, 168 aa, Panicum virgatum
MAAAAPCLAPVPSPSQSPASSPTAASPKAGDRKVVPLTAADEVELEEKHVLAVDDSSVDRAVIAKILRSSKYRVTTVDSATRALELLALGLLPDVNMIITDYWMPGMTGYELLKHVKESSKLKEIPVVIMSSENVPNRISRCLEEGAEGFLLKPVRPSDVSRLCSRIR

SEQ ID NO: 5341 - protein, 170 aa, Sorghum bicolor
MAAAAAPSVSPSPSPATAPAPKVVSPKAGDRKVVPVDAVEVELKLELEEKHVLAVDDSSVDRAVIAKILRSSKYRVTTVESATRALELLALGLLPDVNMIITDYWMPGMTGYELLKHVKESSELREIPVVIMSSENVPTRITRCLEEGAEDFLLKPVRPSDVSRLCSRIR

SEQ ID NO: 5342 - protein, 163 aa, Cynodon dactylon
MAAAAQSPVPAISAPTTKVSSPKAGDRKVVPVTAADEVQQEQMHVLAVDDSNVDRAVIAKILRSSKYRVTTVDSATRALELLCLGLLPDVNMIITDYWMPGMTGYELLKRVKESSELKEIPVVIMSSENVPNRISRCLEEGAEDFLLKPVRPSDVSRLCNRIR

SEQ ID NO: 5343 - protein, 165 aa, Saccharum officinarum
MAAAAAPSVAPSSPLVASPKAGDRKVVPVDAVEVEVELKLELEEKHVLAVDDSSVDRAVIAKILRSSKYRVTTVESATRALELLALGLLPDVNMIITDYWMPGMTGYELLKHVKESSELREIPVVIMSSENVPNRITRCLEEGAEDFLLKPVRPSDVFRLCSRIR

SEQ ID NO: 5344 - protein, 172 aa, Leymus cinereus x Leymus triticoides
MAAAAPTQAPAMTLPAALTAKVASPKAAAADRKVVPVMTDADEVVVQVQAELHVLAVDDSVVDRAVIAKILRSSKYRVTTVDSATRALELLGLGLITDVNMIITDYWMPGMTGYELLKRVKESSELREIPVVIMSSENVPNRITRCLEEGAEDFLLKPVRPSDVSRLCNRFR

SEQ ID NO: 5345 - protein, 176 aa, Triticum aestivum
MAAAAPTQAPAMTLPAAMAAKVAPSPKPTAAGDRKVVPVMTDADEVVVQVQVQAELHVLAVDDSVVDRAVIAKILRSSKYRVTTVDSATRALELLGLGLITDVNMIITDYWMPGMTGYELLKRVKESSELREIPVVIMSSENVPNRITRCLEEGAEDFLLKPVRPSDVSRLCNRIR

SEQ ID NO: 5346 - protein, 172 aa, Triticum aestivum
MAAAAPTQAPAMTLPAAMAAKVAPAPAGDRKVVPLMTDADEVVVQVQVQAELHVLAVDDSVVDRAVIAKILRSSKYRVTTVDSATRALELLGLGLITDVNMIITDYWMPGMTGYELLKRVKESSELREIPVVIMSSENVPNRITRCLEEGAEDFLLKPVRPSDVSRLCNRIR

SEQ ID NO: 5347 - protein, 175 aa, Secale cereale
MAAAAPTQAPAMTLPAAMAAKVASSPKAAGADRKVVPLMTDADEVVVQVQVQAELHVLAVDDSVVDRAVIAKILRSSKYRVTTVDSATRALELLGLGLITDVNMIITDYWMPGMTGYELLKRVKESSELREIPVVIMSSENVPNRITRCLEEGAEDFLLKPVRPSDVSRLCNRIR

SEQ ID NO: 5348 - protein, 176 aa, Secale cereale
MAAAAPTQAPAMTLPAAMAAKVASSPKPAPGGDRKVVPLMTDADEVVVQVQVQAELHVLAVDDSVVDRAVIAKILRSSKYRVTTVDSATRALELLGLGLITDVNMIITDYWMPGMTGYELLKRVKESSELREIPVVIMSSENVPNRITRCLEEGAEDFLLKPVRPSDVSRLCNRIR

SEQ ID NO: 5349 - protein, 169 aa, Avena sativa
MAAAAPTPAPAAMTLPLAQKVSSPKAGDRKVVPVPVMVADEAVQVQEMHVLAVDDSVVDRAVIAKILRSSKYRVTTVESATRALELLGLGLITNVNMIITDYWMPGMTGYELLKRVKESSELREIPVVIMSSENVPTRITRCMEEGAEDFLLKPVRPSDVSRLCSRMIR

SEQ ID NO: 5350 - protein, 175 aa, Brachypodium distachyon
MAAAAPALSLAPMATTVTAAAAQKAASPKAAAGGDVRKVVPVMAAAADEVVVQELHVLAVDDSVVDRAVIAKILRSSKYRVTTVESATRALELLGLGLITNVNMIITDYWMPGMTGYELLKRVKESSELKEIPVVIMSSENVPNRINRCLEEGAEDFLLKPVRPSDVSRLCSRIR

SEQ ID NO: 5351 - protein, 173 aa, Hordeum vulgare
MAAAAPTQAPAMTLPPAMVASSPKPAAVGDRKVVPVMTDADEVVVQVQVQAELHVLAVDDSVVDRAVIAKILRSSKYRVTTVDSATRALELLGLGLITDVNMIITDYWMPGMTGYELLKRVKESSELREIPVVIMSSENVPNRITRCLEEGAEDFLLKPVRPSDVSRLCNRIR

SEQ ID NO: 5352 - protein, 137 aa, Secale cereale
MTDADEVVVQVQVQAELHVLAVDDSVVDRAVIAKILRSSKYRVTTVDSATRALELLGLGLITDVNMIITDYWMPGMTGYELLKRVKESSELREIPVVIMSSENVPNRITRCLEEGAEDFLLKPVRPSDVSRLCNRIR

SEQ ID NO: 5353 - protein, 119 aa, Saccharum officinarum
MAAAAAAAPSVAPLVASPKAGDRKVVPVDAVELELELEEKHVLAVDDSSVDRAVIAKILRSSKYRVTTVESATRALELLALGLLPDVNMIITDYWMPRMTGYELLQHVKESSSLRKIPW

SEQ ID NO: 5354 - protein, 216 aa, Panicum virgatum
MSKLQTEVLKDAISQVVSEAREKNRKFTETIELQIGLKNYDPQKDKRFSGSVKLPHIPRPKMKVCMLGDAQHVEEAENIGLDYMDVEALKKMNKNKKLVKKLAKKYHAFLASEAIIKQIPRLLGPGLNKAGKFPTLVTHQESLESKVNETKATVKFQLKKVLCMGVAVGNLSMEEKQIQQNIQMSVNFLVSLLKKNWQNVRCLYIKSTMGKPNRVF

SEQ ID NO: 5355 - protein, 216 aa, Panicum virgatum
MSKLQTEALKEAISLVVSEAREKNRKFTETIELQIGLKNYDPQKDKRFSGSVKLPHIPRPKMKVCMLGDAQHVEEAEKIGLDYMDVEALKKMNKNKKLVKKLAKKYHAFLASEAIIKQIPRLLGPGLNKAGKFPTLVTHQESLESKVNETKATVKFQLKKVLCMGVAVGNLSMEEKQIQQNIQMSVNFLVSLLKKNWQNVRCLYIKSTMGKPNRVF

SEQ ID NO: 5356 - protein, 216 aa, Panicum virgatum
MSKLQSEVLKDAISQIVGDAKEKNRKFTETVELQIGLKNYDPQKDKRFSGSVKLPHIPRPKMKVCMLGDAQHVEEAEKIGLDYMDVEALKKMNKNKKLVKKLAKKYHAFLASEAIIKQIPRLLGPGLNKAGKFPTLVTHQESLESKVNETKATVKFQLKKVLCMGVAVGNLSMEEKQIQQNIQMSVNFLVSLLKKNWQNVRCLYIKSTMGKPYRVF

SEQ ID NO: 5357 - protein, 216 aa, Oryza sativa
MSKLQTEALKEAISQVVADCKEKNRKFTETVELQIGLKNYDPQKDKRFSGSVKLPHIPRPKMKVCMLGDAQHVEEAEKIGLDYMDVEALKKMNKNKKLVKKLAKKYHAFLASEAIIKQIPRLLGPGLNKAGKFPTLVTHQESLESKVNETKATVKFQLKKVLCMGVAVGNLSMEEKQIQQNIQMSVNFLVSLLKKNWQNVRCLYIKSTMGKPYRVF

SEQ ID NO: 5358 - protein, 216 aa, Oryza sativa
MSKLQSEVLKEAISQVVGESKEKGRKFTETVELQIGLKNYDPQKDKRFSGSVKLPHIPRPKMKVCMLGDAQHVEEAEKIGLDYMDVEALKKMNKNKKLVKKLAKKYHAFLASEAIIKQIPRLLGPGLNKAGKFPTLVTHQESLESKVNETKATVKFQLKKVLCMGVAVGNLSMEEKQIQQNIQMSVNFLVSLLKKNWQNVRCLYIKSTMGKPIRVF

SEQ ID NO: 5359 - protein, 216 aa, Panicum virgatum
MSKLQSEALKDAISQIVGDAKEKNRKFTETVELQIGLKNYDPQKDKRFSGSVKLPHIPRPKMKVCMLGDAQHVEEAEKIGLDYMDVEALKKMNKNKKLVKKLAKKYHAFLASEAIIKQIPRLLGPGLNKAGKFPTLVTHQESLESKVNETKATVKFQLKKVLCMGVAVGNLSMEEKQIQQNIQMSVNFLVSLLKKNWQNVRCLYIKSTMGKPYRVF

SEQ ID NO: 5360 - protein, 216 aa, Setaria italica
MSKLQSEVLKEAISQIVGDSKEKNRKFTETVELQIGLKNYDPQKDKRFSGSVKLPHIPRPKMKVCMLGDAQHVEEAEKIGLDYMDVEALKKMNKNKKLVKKLAKKYHAFLASEAIIKQIPRLLGPGLNKAGKFPTLVTHQESLESKVNETKATVKFQLKKVLCMGVAVGNLSMEEKQIQQNIQMSVNFLVSLLKKNWQNVRCLYIKSTMGKPYRVF

SEQ ID NO: 5361 - protein, 216 aa, Saccharum officinarum
MSKLQSEVLKDAISQIVGDAKEKNRKFTETVELQIGLKNYDPQKDKRFSGSVKLPHIPRPKMKVCMLGDAQHVEEAEKMGLDYMDVEALKKMNKNKKLVKKLAKKYHAFLASEAIIKQIPRLLGPGLNKAGKFPTLVTHQESLESKVNETKATVKFQLKKVLCMGVAVGNLSMEEKQIQQNIQMSVNFLVSLLKKNWQNVRCLYVKSTMGKPYRVF

SEQ ID NO: 5362 - protein, 216 aa, Sorghum bicolor
MSKLQSEVLKDAISQIVGDAKEKNRKFTETVELQIGLKNYDPQKDKRFSGSVKLPHIPRPKMKVCMLGDAQHVEEAEKMGLDYMDVESLKKMNKNKKLVKKLAKKYHAFLASEAIIKQIPRLLGPGLNKAGKFPTLVTHQESLESKVNETKATVKFQLKKVLCMGVAVGNLSMEEKQIQQNIQMSVNFLVSLLKKNWQNVRCLYVKSTMGKPYRVF

SEQ ID NO: 5363 - protein, 216 aa, Zea mays
MSKLQSESVKDAISQIVGDAKEKNRKFTETVELQIGLKNYDPQKDKRFSGSVKLPHIPRPKMKVCMLGDAQHVEEAEKMGLDYMDVEALKKMNKNKKLVKRLAKKYHAFLASEAIIKQIPRLLGPGLNKAGKFPTLVTHQESLESKVNETKATVKFQLKKVLCMGVAVGNLAMEEKQIQQNIQMSVNFLVSLLKKNWQNVRCLYVKSTMGKPYRVF

SEQ ID NO: 5364 - protein, 216 aa, Pennisetum glaucum
MSKLQTEVLKEAISQIVVASKEKNRKFTETVELQIGLKNYDPQKDKRFSGSVKLPHIPRPKMKVCMLGDAQHVEEAEKLGLDYMDVESLKKMNKNKKLVKKLAKKYHAFLASEAIIKQIPRLLGPGLNKAGKFPTLVSHQESLEAKVNETKATVKFQLKKVLCMGVAVGNLSMEEKQIQQNIQMSVNFLVSLLKKNWQNVRCLYVKSTMGKPYRVF

SEQ ID NO: 5365 - protein, 216 aa, Brachypodium distachyon
MSKLQTEALKEAITQVVTEAKEKNRKFTETVELQIGLKNYDPQKDKRFSGSVKLPHVPRPKMRVCMLGDAQHVGEAEKIGLDSMDVEALKKMNKNKKLVKRLAKKYHAFLASEAIIKQIPRLLGPGLNKAGKFPTLVSHQESLEAKVNETKATIKFQLKKVLCMGVAVGNLSMEEKQIQQNIQMSVNFLVSLLKKNWQNVRCLYIKSTMGKPVRVF

SEQ ID NO: 5366 - protein, 216 aa, Hordeum vulgare
MSKLQTEALKEAITQVVADAKEKNRKFTETVELQIGLKNYDPQKDKRFSGSVKLPHVPRPKMRVCMLGDAQHVGEAEKIGLDSMDVEALKKMNKNKKLVKRLAKKYHAFLASEAIIKQIPRLLGPGLNKAGKFPTLVSHQESLEAKVNETKATIKFQLKKVLCMGVAVGNLSMEEKQIQQNIQMSVNFLVSLLKKNWQNVRCLYIKSTMGKPVRVF

SEQ ID NO: 5367 - protein, 216 aa, Cynodon dactylon
MSKLQTEVLKDGIPNVLQDAQEKNRKFPETIELPIGPQNYDPQKDKRFSGSVKLPHIPRPKMKVCMLGDAQHVEEAEKMGLDYMDVEALKKMNKNKKLVKKLAKKYHAFLASEAIIKQIPRLLGPGLNKAGKFPTLVTHQESLESKVNETKATVKFQLKKVLCMGVAVGNLSMEEKQIQQNIQMSVNFLVSLLKKNWQNVRCLYIKSTMGKPYRLF

SEQ ID NO: 5368 - protein, 216 aa, Leymus cinereus x Leymus triticoides
MSKLQTEALKEAITQVVAEAKEKNRKFTETVELQIGLKNYDPQKDKRFSGSVKLPHVPRPKMRVCMLGDAQHVGEADKIGLDSMDVEALKKMNKNKKLVKRLAKKYHAFLASEAIIKQIPRLLGPGLNKAGKFPTLVSHQESLEAKVNETKATIKFQLKKVLCMGVAVGNLSMEEKQIQQNIQMSVNFLVSLLKKNWQNVRCLYIKSTMGKPVRVF

SEQ ID NO: 5369 - protein, 215 aa, Zea mays
MSKLHSELLKDCISQIVQDAKKNRKFTETVELQISLKNYDPQKDKRFSGSVKLPHIPRPKMKVCMLGDAQHVEEAEKMGLDYMDVEALKKMNKNKKLVKKLAKKYHAFLASETIIKQIPRLLGPGLNKAGKFPTLVTHQESLESKVNETKATVKFQLKKVLCMGVAVGNLSMEEKQIQQNIQMSINFLVSLLKKNWQNVRCLYIKSTMGKPFRIF

SEQ ID NO: 5370 - protein, 216 aa, Pseudoroegneria spicata
MSKLQTDVLKEAITQVVADAKEKNRKFTETVELQIGLKNYDPQKDKRFSGSVKLPHVPRPKMRVCMLGDAQHVGEAEKIGLDAMDVEALKKMNKNKKLVKRLAKKYHAFLASEAIIKQIPRLLGPGLNKAGKFPTLVSHQESLEAKVNETKATIKFQLKKVLCMGVAVGNLSMEEKQIQQNIQMSVNFLVSLLKKNWQNVRCLYIKSTMGKPVRVF

SEQ ID NO: 5371 - protein, 216 aa, Avena sativa
MSKLSTEALKEAITQVVSEAKEKNRKFTETIELQIGLKNYDPQKDKRFSGSVKLPHVPRPKMRVCMLGDAQHVGEAEKIGLDSMDVEALKKMNKNKKLVKRLAKKYHAFLASEAIIKQIPRLLGPGLNKAGKFPTLVSHSESLEAKVNETKATIKFQLKKVLCMGVAVGNLSMEEKQIQQNIQMSVNFLVSLLKKNWQNVRCLYIKSTMGKPSRVF

SEQ ID NO: 5372 - protein, 216 aa, Leymus cinereus x Leymus triticoides
MSKLQTEALKEAITQVVAEAKEKNRKFTETVELQIGLKNYDPQKDKRFSGSVKLPHVPRPKMRVCMLGDAQHVGEADKIGLDSMDVEALKKMNKNKKLVKRLAKKYHAFLASEAVIKQIPRLLGPGLNKAGKFPTLVSHQESLEAKVNETKATIKFQLKKVLCMGVAVGNLSMEEKQIQQNIQMSVNFLVSLLKKNWQNVRCLYIKSTMGKPVRVF

SEQ ID NO: 5373 - protein, 216 aa, Ananas comosus
MSKLQSDALKEAISQVVGDSREKKRKFTETVELQIGLKNYDPQKDKRFSGSVKLPHIPRPKMKVCMLGDAQHVEEAEKIGLDYMDVEGLKKMNKNKKLVKKLAKKYHAFLASEAIIKQIPRLLGPGLNKAGKFPTLVTHQESLEAKVNETKATVKFQLKKVLCMGVAVGNCGMEEKQIQQNVQLSVNFLVSLLKKNWQNVRCLYLKSTMGKPYRVF

SEQ ID NO: 5374 - protein, 216 aa, Triticum aestivum
MSKLQTDALKEAITQVVADAKEKNRKFTETVELQIGLKNYDPQKDKRFSGSVKLPHVPRPKMRVCMLGDAQHVGEAEKIGLDSMDVEALKKMNKNKKLVKRLAKKYHAFLASEAIIKQIPRLLGPGLNKAGKFPTLVSHQESLEAKVNETKATIKFQLKKVLCMGVAVGNLSMEEKQIQQNIQMSVNFLVSLLKKNWQNVRCLYIKSTMGKPVRVF

SEQ ID NO: 5375 - protein, 155 aa, Secale cereale
MRVCMLGDAQHVGEADKIGLDSMDVEALKKMNKNKKLVKRLAKKYHAFLASEAIIKQIPRLLGPGLNKAGKFPTLVSHQESLEAKVNETKATIKFQLKKVLCMGVAVGNLSMEEKQIQQNIQMSVNFLVSLLKKNWQNVRCLYIKSTMGKPVRVF

SEQ ID NO: 5376 - protein, 358 aa, Zea mays
MDSDAAAICGHGVGTTADGDLCTFCGFPMCRPCYEYNREDDTQVCPQCKTNKRHQVATSSLLVSRLVPALPPLPEAASSLTNSKSFDSFGELLRFLFVFFAANAMASFDTQQYMSVICVRREQLRVTRVTKHCLRYVSQASYVSIKLQSEVLKDAISQIVQDAKKNRKFTETVELQISLKNYDPQKDKRFSGSMKLPHIPHPKMKVCMLGDAQHVEEAEKMGLDYMDVEALKKMNKNKKLVKKLAEKYHAFLASETIIKQIPRLHGPGLNKAGKFPTLVTHQESLESKVNETKATVKFQLKKVLCMGVVVGNLSMEEKQIQQNIQMSVNFLVSLLKKNWQNVRCLYIKSTMGKPCRVF

SEQ ID NO: 5377 - protein, 216 aa, Secale cereale
MSKLSTEALKEAITQVVADAKEKNRKFTETVELQIGLKNYDPQKDKRFSGSVKLPHVPRPKMRVCMLGDAQHVGEADKIGLDSMDVEALKKMNKNKKLVKRLAKKYHAFLASEAIIKQIPRLLGPGLNKAGKFPTLVSHQESLEAKVNETKATIKFQLKKVLCMGVAVGNLSMEEKQIQQNIQMSVNFLVSLLKKNWQNVRCLYIKSTMGKPVRVF

SEQ ID NO: 5378 - protein, 216 aa, Musa acuminata
MSKLQSDVLREAISQVVGDSREKKRKFTETVELQIGLKNYDPQKDKRFSGSVKLPHIPRPKMKVCMLGDAQHVEEAEKIGLDYMDVEGLKKMNKNKKLVKKLAKKYHAFLASEAIIKQIPRLLGPGLNKAGKFPTLVTHQESLESKVNETKAMVKFQLKKVLCMGVAVGNCTMEEKQIFQNVQLSVNFLVSLLKKNLQNVRCLYLKSTMGKPNRVF

SEQ ID NO: 5379 - protein, 216 aa, Avena sativa
MSKLSTEALKEAITQVVTEAKEKNRKFTETIELQIGLKNYDPQKDKRFSGSVKLPHVPRPKMRVCMLGDAQHVGEAEKIGLDSMDVEALKKMNKNKKLVKRLAKKYHAFLASEAIIKQIPRLLGPGLNKAGKFPTLVSHSESLEAKVNETKATIKFQLKKVLCMGVAVGNLSMEEKQIQQNIQMSVNFLVSLLKKNWQNVRCLYIKSTMGKPARVF

SEQ ID NO: 5380 - protein, 216 aa, Triticum aestivum
MSKLSTDALKEAITQVVADAKEKNRKFTETVELQIGLKNYDPQKDKRFSGSVKLPHVPRPKMRVCMLGDAQHVGEAEKIGLDSMDVEALKKMNKNKKLVKRLAKKYHAFLASEAIIKQIPRLLGPGLNKAGKFPTLVSHQESLEAKVNETKATIKFQLKKVLCMGVAVGNLSMEEKQIQQNIQMSVNFLVSLLKKNWQNVRCLYIKSTMGKPVRVF

SEQ ID NO: 5381 - protein, 216 aa, Musa acuminata
MSKLQSDVLREAISQVVGDSREKKRKFTETVELQIGLKNYDPQKDKRFSGSVKLPHIPRPKMKVCMLGDAQHVEEAEKIGLDYMDVESLKKMNKNKKLVKKLAKKYHAFLASEAIIKQIPRLLGPGLNKAGKFPTLVTHQESLEAKVNETKAMVKFQLKKVLCMGVAVGNCAMEEKQIFQNVQLSVNFLVSLLKKNWQNVRCLYLKSTMGKPYRVF

SEQ ID NO: 5382 - protein, 216 aa, Musa acuminata
MSKLQSDVLREAISQVAGDSREKKRKFTETVELQIGLKNYDPQKDKRFSGSVKLPHIPRPKMKVCMLGDAQHVEEAEKIGLDYMDVEGLKKMNKNKKLVKKLAKKYHAFLASEAIIKQIPRLLGPGLNKAGKFPTLVTHQESLESKVNETKAMVKFQLKKVLCMGVAVGNCAMEEKQIFQNVQLSVNFLVSLLKKNWQNVRCLYLKSTMGKPYRVF

SEQ ID NO: 5383 - protein, 437 aa, Zea mays
MTVAALQAMDALSRWGTMLRDSAAKPREHGQHGHHPRLLRPPPLRARGPLLHRAFQHEIWVEFNLEHMWKSPNGTTRNIINVHIFPCMINPLIKKAEETTLISDIVVDLAHKIFIEGIARVISSGTMCNREGRGADCFDRDITSLEECPRVMEELLAVSLRCIPPVNERPNMKPVCDDLCSITVQRNTDGMVTILGSFDNRLSALDAAMRPTQVRTHAIRTAHENIDWTIKAVDDILSQFDLARRIRDMKQLRLRFQFFASAMSFNIMPEEQQVNESFLPSHFRNFWQRLQLSKLQSEVLKDAISQIVQDAKKNRKFTETVELQISLKNYDPQKDKRFSGSIKLPHIPRPKMKVCMLGDAQHVEEAEKMGLDYMDVEALKKMNRNKKLVKKLVKKYHAFLASETIIKQIPRLLGPGLNKADKYSPLWSLTRNSWNPR

SEQ ID NO: 5384 - protein, 216 aa, Oryza sativa
MSKLQSDALREAISQITSESREKQRKFVETIELQIGLKNYDPQKDKRFSGSVKLPHIPRPKMKVCMLGDAQHVEEAEKMGLDYMDVEALKKMNKNKKLVKKLAKKYHAFLASEAIIKQIPRLLGPGLNKAGKFPTLVTHQESLESKVNETKATVKFQLKKVLCMGVAVGNCAMEEKQIFQNVQMSVNFLVSLLKKNWQNVRCLYLKSTMGKVIRVF

SEQ ID NO: 5385 - protein, 216 aa, Secale cereale
MSKLQSEAVKDAITQIVGEAREKKRKFTETVELQIGLKNYDPQKDKRFSGSVKLPHIPRPKMRVCMLGDAQHVDQAEKMGLDYMDVESLKKMNKNKKLVKKLAKKYHAFLASEAIIKQIPRLLGPGLNKAGKFPTLVSHQESLEAKVNETKATIKFQLKKVLCMGVAVGNLSMDEKQIQQNIQMSVNFLVSLLKKNWQNVRCLYVKSTMGKRVRVF

SEQ ID NO: 5386 - protein, 216 aa, Unknown
  Sequence found in Organisms: Hordeum vulgare, Triticum aestivum
MSKLQSDAVKDAITQIVGEAREKKRKFTETVELQIGLKNYDPQKDKRFSGSVKLPHIPRPKMRVCMLGDAQHVDQAEKMGLDYMDVESLKKMNKNKKLVKKLAKKYHAFLASEAIIKQIPRLLGPGLNKAGKFPTLVSHQESLEAKVNETKATVKFQLKKVLCMGVAVGNLSMDEKQIQQNIQMSVNFLVSLLKKNWQNVRCLYVKSTMGKRVRVF

SEQ ID NO: 5387 - protein, 152 aa, Zea mays
ILPIDYCSKLESEVLKDVVSQIVQDAKKNRKFTETVELQISLKNYDQQKDKSFSGSVKLPRIPRPKMKVCMLGDAQHVEEAEKMGLDYMDVEALKKMNKNKKLVKKLAKKYHAFLASETIIKQIPRLLGPGLNKAGKYSPLWSLTRNPWNPR

SEQ ID NO: 5388 - protein, 216 aa, Amorphophallus konjac
MSKLQSDVLREAIGQLVTDSKEKKRKFTETIELQIGLKNYDPQKDKRFSGSVKLPHIPRPKMKVCMLGDAQHVEEAEKIGLDYMDVEALKKMNKNKKLVKKLAKKYHAFLASEAIIKQIPRLLGPGLNKAGKFPTLVTHQESLESKVNETKAMVKFQLKKVLCMGVAVGNCGMEEKQIFQNVQLSVNFLVSLLKKNWQNVRCLYLKSTMGKPVRVF

SEQ ID NO: 5389 - protein, 216 aa, Elaeis guineensis
MSKLQSDVLREAISQITNDSREKKRNFTETIELQIGLKNYDPQKDKRFSGSVKLPHIPRPKMKVCMLGDAQHVEEAEKIGLDYMDVEALKKMNKNKKLVKKLAKKYHAFLASEAIIKQIPRLLGPGLNKAGKFPTLVTHQESLEAKVNETKAMVKFQLKKVLCMGVAVGNCSMEEKQIFQNVQLSVNFLVSLLKKNWQNVRCLYLKSTMGKPYRVF

SEQ ID NO: 5390 - protein, 216 aa, Elaeis guineensis
MSKLQSDVLREAISQLTNDSREKKRNFTETIELQIGLKNYDPQKDKRFSGSVKLPHIPRPKMKVCMLGDAQHVEEAEKIGLDYMDVEALKKMNKNKKLVKKLAKKYHAFLASEAIIKQIPRLLGPGLNKAGKFPTLVTHQESLESKVNETKAMVKFQLKKVLCMGVAVGNCAMEEKQIFQNVQLSVNFLVSLLKKNWQNVRCLYLKSTMGKPYRVF

SEQ ID NO: 5391 - protein, 216 aa, Triticum aestivum
MSKLQSDAVKDAITQIVGEAREKKRKFTETVELQIGLKNYDPQKDKRFSGSVKLPHIPRPKMRVCMLGDAQHVDQAEKMGLDYMDVESLKKMNKNKKLVKKLAKKYHAFLASEAIIKQIPRLLGPGLNKAGKFPTLVSHQESLKAKVNETKATVKFQLKKVLCMGVAVGNLSMDEKQIQQNIQMSVNFLVSLLKKNWQNVRCLYVKSTMGKRVRVF

SEQ ID NO: 5392 - protein, 216 aa, Distylium racemosum
MSKLQSDVLREAITQVMADSKEKNRKFTETIELQIGLKNYDPQKDKRFSGSVKLPHIPRPKMKVCMLGDAQHVEEAEKIGLDYMDVEALKKMNKNKKLVKKLAKKYHAFLASEAIIKQIPRLLGPGLNKAGKFPTLVSHQESLEAKVNETKATVKFQLKKVLCMGVAVGNCGMEEKQVFQNVQMSVNFLVSLLKKNWQNVRCLYLKSTMGKPSRIF

SEQ ID NO: 5393 - protein, 216 aa, Actinidia deliciosa
MSKLQSEALREAISQIANDAKEKKRNFTETIELQIGLKNYDPQKDKRFSGSVKLPHIPRPKMKVCMLGDAQHVEEAEKIGLEYMDVEGLKKLNKNKKLVKKLAKKYHAFLASEAVIKQIPRLLGPGLNKAGKFPTLVTHQESLESKVNETKATVKFQLKKVLCMGVAVGNCSMEEKQIFQNVQMSVNFLVSLLKKNWQNVRCLYLKSTMGKPVRVF

SEQ ID NO: 5394 - protein, 216 aa, Pseudoroegneria spicata
  misc_feature (17)..(17): Xaa can be any naturally occurring amino acid
MSKLQSDAVKDAITQIXGEAREKKRKFTETVELQIGLKNYDPQKDKRFSGSVKLPHIPRPKMRVCMLGDAQHVDQAEKMGLDYMYVESLKKMNKNKKLVKKLAKKYHAFLASEAIIKQIPRLLGPGLNKAGKFPTLVSHQESLEAKVNETKATVKFQLKKVLCMGVAVGNLSMDEKQIQQNIQMSVNFLVSLLKKNWQNVRCLYVKSTMGKRVRVF

SEQ ID NO: 5395 - protein, 155 aa, Phalaenopsis aphrodite
MKVCMLGDAQHVEEAEKIGLDWMDVEALKKMNKNKKLVKKLAKKYHAFLASEAIIKQIPRLLGPGLNKAGKFPTLVTHQESLESKVNETKAMVKFQLKKVLCMGVAVGNCAMEEKQIFQNVQLSVNFLVSLLKKNWQNVRCLYMKSTMGKPYRVF

SEQ ID NO: 5396 - protein, 58 aa, Zea mays
MGVAVGNLSMEEKQIQQNIQMSVNFLVSLLTKNWQNVRCLYIKSTMGNHAGCSKSAFL

SEQ ID NO: 5397 - protein, 98 aa, Triticum aestivum
MSKLQSDAVKDAITQIVGEAREKKRKFTETVELQIGLKNYDPQKDKRFSGQVKLPHIPRPKMRVCMLGDAQHVDQAEKMGLDYMDVESLKKMNKNKKL

SEQ ID NO: 5398 - protein, 126 aa, Eragrostis curvula
RKIHLRKEGHPPSVVAEAKEKNRKFTETVELQIGLKNYDPQKDKRFSGSVKLPHIPRPKMKVCMLGDAQHVEEAEKMGLDYMDVEALKKMNKNKKLVKKLAKKYHAFLASEAIIKQIPRLLGPGLN

SEQ ID NO: 5399 - protein, 216 aa, Chelidonium majus
MSKLQSDVLREAITQIVNDAKEKKRNFTETIELQIGLKNYDPQKDKRFSGSVKLPHIPRPKMKVCMLGDAQHVEEAEKIGLSYMDVEGLKKLNKNKKLVKKLAKKYHAFLASEAVIKQIPRLLGPGLNKAGKFPTLVTHQESLESKVNETKAMVKFQLKKVLCMGVAVGNLGMEEKQIFQNVQLSVNFLVSLLKKNWQNVRCLYLKSTMGKPNRVF

SEQ ID NO: 5400 - protein, 216 aa, Chelidonium majus
MSKLQSEVLREAITQINGEAKEKKRNFTETVELQIGLKNYDPQKDKRFSGSVKLPHIPRPKMKVCMLGDAQHVEEAEKIGLAYMDVEGLKKLNKNKKLVKKLAKKYHAFLASEAVIKQIPRLLGPGLNKAGKFPTLVTHQESLESKVNETKAMVKFQLKKVLCMGVAVGNLGMEEKQIFQNVQLSVNFLVSLLKKNWQNVRCLYLKSTMGKPVRIF

SEQ ID NO: 5401 - protein, 216 aa, Avena sativa
MSKLSSEAVKDAITQIVGEAREKKRKFTETVELQIGLKNYDPQKDKRFSGSVKLPHIPRPKMRVCMLGDAQHVDQAEKLGLDSMDVESLKKMNKNKKLVKKLAKKYHAFLASEAIIKQIPRLLGPGLNKAGKFPTLVSHSESLEAKVNETKATVKFQLKKVLCMGVAVGNLSMDEKQIQQNLQMSVNFLVSLLKKNWQNVRCLYVKSTMGKRVRVF

SEQ ID NO: 5402 - protein, 216 aa, Elaeis guineensis
MSKLQSDVLREAISQIANDAREKKRNFIETIELQIGLKNYDPQKDKRFSGSVKLPHIPRPKMKVCMLGDAQHVEEAEKIGLDYMDVEGLKKMNKNKKLVKKLAKKYHAFLASEAIIKQIPRLLGPGLNKAGKFPTLVTHQESLEAKVNETKAMVKFQLKKVLCMGVAVGNCAMEEKQIFQNVQLSVNFLVSLLKKNWQNVRCLYLKSTMGKPYRVF

SEQ ID NO: 5403 - protein, 202 aa, Oryza sativa
MSKLQSEVLKEAISQVVGESKEKGRKFTETVELQIGLKNYDPQKDKRFSGSVKLPHIPRPKMKVCMLGDAQHVEEAEKIGLDYMDVEALKKMNKNKKLVKKLAKKYHAFLASEAIIKQIPRLLGPGLNKAGKFPTLVTHQESLESKVNETKATVKFQLKKVLCMGVAVGNLSMEEKQIQQNIQMSVNFLVSLLKKNWQNVSY

SEQ ID NO: 5404 - protein, 216 aa, Aristolochia fimbriata
MSKLQSDVLREAIGQVMDVAKDKNRNFTETIELQIGLKNYDPQKDKRFSGSVKLPHIPRPKMKVCMLGDAQHVEEAEKIGLDYMDVEALKKMNKNKKLVKKLAKKYHAFLASEAIIKQIPRLLGPGLNKAGKFPTLVSHQESLESKVNETKAMVKFQLKKVLCMGVAVGNCGMEEKQVFQNVQLSVNFLVSLLKKNWQNVRCLYLKSTMGKPVRVF

SEQ ID NO: 5405 - protein, 216 aa, Brachypodium distachyon
MSKLQSEAVKDAITQIVGDAREKKRKFTETVELQIGLKNYDPQKDKRFSGSVKLPHIPRPKMRVCMLGDAQHVDQAEKLGLACMDVESLKKMNKNKKLVKKLAKKYHAFLASEAIIKQIPRLLGPGLNKAGKFPTLVSHQESLEAKVNETKATIKFQLKKVLCMGVAVGNLSMDEKQIQQNIQMSVNFLVSLLKKNWQNVRCLYVKSTMGKRVRVF

SEQ ID NO: 5406 - protein, 216 aa, Nuphar advena
MSKLQSDALREAITQVVGEARDKKRKFTETIELQIGLKNYDPQKDKRFSGSVKLPHIPRPKMKVCMLGDAQHVEEAEKIGLDYMDVEGLKKMNKNKKLVKKLAKKYHAFLASEAIIKQIPRLLGPGLNKAGKFPTLVSHQESLESKVNETKAMVKFQLKKVLCMGVAVGNCGMEEKQIFQNVQLSVNFLVSLLKKNWQNVRCLYLKSTMGRAIRVF

SEQ ID NO: 5407 - protein, 216 aa, Oryza sativa
MSKLQSDALREAISQIANDSREKQRKFVETIELQIGLKNYDPQKDKRFSGSVKLPHIPRPKLKVCMLGDAQHVEEAEKMGLDYMDVEALKKMNKNKKLVKKLAKKYHAFLASEAIIKQIPRLLGPGLNKAGKFPTLVTHQESLESKVNETKATVKFQLKKVLCMGVAVGNCAMEEKQIFQNVQMSVNFLVSLLKKNWQNVRCLYLKSTMGKVYRVF

SEQ ID NO: 5408 - protein, 216 aa, Humulus lupulus
MSKLQSEVLREAIATIMNESREKKRNFTETIELQIGLKNYDPQKDKRFSGSVKLPHIPRPKMKVCMLGDAQHVEEAEKIGLDYMDVEGLKKLNKNKKLVKKLAKKYHAFLASEAVIKQIPRLLGPGLNKAGKFPTLVTHQESLESKVNETKAMVKFQLKKVLCMGVAVGNLSMEEKQVFQNVQMSVNFLVSLLKKNWQNVRCLFLKTTMGKPQRVF

SEQ ID NO: 5409 - protein, 216 aa, Unknown
  Sequence found in Organisms: Pinus pinaster, Pinus taeda
MSKLQSDALREAISQIMGDTKEKQRKFTETIELQIGLKNYDPQKDKRFSGSVKLPHIPRPKMKVCMLGDAQHVEEAEKLGLDYMDVEGLKKMNKNKKLVKKLAKKYHAFLASEAIIKQIPRLLGPGLNKAGKFPTLVSHQESLEGKVNETKATVKFQLKKVLCMGVAVGNCGMEEKQIFQNVQLSVNFLVSLLKKNWQNVRCLYLKSTMGKPNRVF

SEQ ID NO: 5410 - protein, 212 aa, Elaeis guineensis
MSKLQSDVLREAISQLTNDSREKKRNFTETIELQIGLKNYDPQKDKRFSGSVKLPHIPRPKMKVCMLGDAQHVEEAEKIGLDYMDVEALKKMNKNKKLVKKLAKKYHAFLASEAIIKQIPRLLGPGLNKAGKFPTLVTHQESLESKVNETKAMVKFQLKKVLCMGVAVGNCAMEEKQIFQNVQLSVNFLVSLLKKNWQNVRCLYLKSTMGKP

SEQ ID NO: 5411 - protein, 216 aa, Phalaenopsis aphrodite
MSKLQSDVLREAISQLVNDSREKKRNFTETIELQIGLKNYDPQKDKRFSGSVKLPHIPRPKMKVCMLGDAQHVEEAEKIGLEWMDVEGLKKMNKNKKLVKKLAKKYHAFLASEAIIKQIPRLLGPGLNKAGKFPTLVTHQETLESKVNETKAMVKFQLKKVLCMGVAVGNCAMEEKQIFQNVQLSVNFLVSLLKKNWQNVRCLYLKSTMGKPYRVF

SEQ ID NO: 5412 - protein, 216 aa, Sarracenia psittacina
MSKLQSEALREAISQISNDAKEKKRNFTETIELQIGLKNYDPQKDKRFSGSVKLPHIPRPKMKVCMLGDAQHVEEAEKIGLEYMDVEGLKKLNKNKKLVKKLAKKYHAFLASEAVIKQIPRLLGPGLNKAGKFPTLVSHQESLESKVNETKATVKFQLKKVLCMGVAVGNCSMEEKQIFQNVQMSVNFLVSLLKKNWQNVRCLYLKSTMGKPVRIF

SEQ ID NO: 5413 - protein, 216 aa, Picea glauca
MSKLQSDVLREAISQVMADSKEKQRKFTETIELQIGLKNYDPQKDKRFSGSVKLPHIPRPKMKVCMLGDAQHVEEAEKLGLDYMDVEGLKKMNKNKKLVKKLAKKYHAFLASEAIIKQIPRLLGPGLNKAGKFPTLVSHQESLEGKVNETKATVKFQLKKVLCMGVAVGNCGMEEKQIFQNVQLSVNFLVSLLKKNWQNVRCLYLKTTMGKPNRIF

SEQ ID NO: 5414 - protein, 216 aa, Tabernaemontana elegans
MSKLQSDALREAISQIKNDAAEKKRKFTETIELQIGLKNYDPQKDKRFSGSVKLPHIPRPKMKVCMLGDAQHVEEAEKIGLEYMDVEGLKKLNKNKKLVKKLAKKYHAFLASEAVIKQIPRLLGPGLNKAGKFPTLVTHQESLESKVNETKATVKFQLKKVLCMGVAVGNCDMEEKQIFQNVQMSVNFLVSLLKKNWQNVRCLYLKSTMGKPQRIF

SEQ ID NO: 5415 - protein, 216 aa, Persea americana
MSKLQSDVLREAISIVVADAREKKRNFTETIELQIGLKNYDPQKDKRFSGSVKLPHIPRPKMKVCMLGDAQHVEEAEKMGLEYMDVEGLKKMNKNKKLVKKLAKKYHAFLASEAIIKQIPRLLGPGLNKAGKFPTLVSHQESLESKVNETKAMVKFQLKKVLCMGVAVGNCGMEEKQIFQNVQLSVNFLVSLLKKNWQNVRCLYLKSSMGKPNRIF

SEQ ID NO: 5416 - protein, 216 aa, Panax ginseng
MSKLQSDALREAITQISNEAKEKKRNFTETIELQIGLKNYDPQKDKRFSGSVKLPHIPRPKMKVCMLGDAQHVEEAEKIGLEYMDVEGLKKLNKNKKLVKKLAKKYHAFLASEAVIKQIPRLLGPGLNKAGKFPTLVTHQESLESKVNETKATVKFQLKKVLCMGVAVGNLSMEEKQIFQNVQMSVNFLVSLLKKNWQNVRCLYLKSTMGKTVRIF

SEQ ID NO: 5417 - protein, 216 aa, Arachis hypogaea
MSKLQSDALREAISQLVANANEKKRKFTETVELQIGLKNYDPQKDKRFSGSVKLPHIPRPKMKICMLGDAQHVEEAEKIGLDWMDVEALKKLNKNKKLVKKLAKKYHAFLASEAVIKQIPRLLGPGLNKAGKFPTLVTHQESLESKVNETKAMVKFQLKKVLCMGVAVGNCSMEEKQIFQNVQLSVNFLVSLLKKNWQNVRCLYLKSTMGSAIRVF

SEQ ID NO: 5418 - protein, 216 aa, Pseudotsuga menziesii
MSKLQSDALREAISQVMADSKEKQRKFTETIELQIGLKNYDPQKDKRFSGSVKLPHIPRPKMKVCMLGDAQHVEEAEKLGLDYMDVEGLKKMNKNKKLVKKLAKKYHAFLASEAIIKQIPRLLGPGLNKAGKFPTLVSHQESLEGKVNETKATVKFQLKKVLCMGVAVGNCGMEEKQIFQNVQLSVNFLVSLLKKNWQNVRCLYLKSTMGKPNRIF

SEQ ID NO: 5419 - protein, 216 aa, Glycine max
MSKLQSDALREAISQVVSNSKEKNRKFTETIELQIGLKNYDPQKDKRFSGSVKLPHIPRPKMKICMLGDAQHVEEAEKIGLDYMDVEALKKLNKNKKLVKKLAKKYHVFLASEAVIKQIPRLLGPGLNKAGKFPTLVTHQESLESKVNETKAMVKFQLKKVLCMGVAVGNCTMEEKQIFQNVQLSVNFLVSLLKKNWQNVRCLYLKSTMGSAIRVF

SEQ ID NO: 5420 - protein, 186 aa, Abies balsamea
MSKLQSDALREAISQVMADSKEKQRKFTETIELQIGLKNYDPQKDKRFSGSVKLPHIPRPKMKVCMLGDAQHVEEAEKLGLDYMDVEGLKKMNKNKKLVKKLAKKYHAFLASEAIIKQIPRLLGPGLNKAGKFPTLVSHQESLEGKVNETKATVKFPIKKGTMYGGCCRKLWNGGKTNFSECAIEC

SEQ ID NO: 5421 - protein, 186 aa, Picea glauca
MSKLQSDVLREAISQVMADSKEKQRKFTETIELQIGLKNYDPQKDKRFSGSVKLPHIPRPKMKVCMLGDAQHVEEAEKLGLDYMDVEGLKKMNKNKKLVKKLAKKYHAFLASEAIIKQIPRLLGPGLNKAGKFPTLVSHQESLEGKVNETKATVKFQIKKGTMYGGCCGKLWNGRKTNFSECAIEC

SEQ ID NO: 5422 - protein, 216 aa, Elaeis guineensis
MSKLQSDVLREAISQIMNDTKEKKRNFTETIELQIGLKNYDPQKDKRFSGSVKLPHIPRPKMKVCMLGDAQHVEEAEKIGLDYMDVEGLKKMNKNKKLVKKLAKKYHAFLASEAIIKQIPRLLGPGLNKAGKFPTLVTHQESLEAKVNETKAMVKFQLKKVLCMGVAVGNCAMEEKQVFQNVQLSVNFLVSLLKKNWQNVRCLYLKSTMGKPYRVF

SEQ ID NO: 5423 - protein, 216 aa, Lippia dulcis
MSKLQSDALREAISVITSDAKEKKRNFTETVELQIGLKNYDPQKDKRFSGSVKLPHIPRPKMKICMLGDAQHVEEAAKIGLESMDVEALKKLNKNKKLVKKLAKKYHAFLASEAVIKQIPRLLGPGLNKAGKFPTLVTHQESLESKVNETKATVKFQLKKVLCMGVAVGNLDMEEKQIFQNVQMSVNFLVSLLKKNWQNVRCLYLKSTMGKPQRIF

SEQ ID NO: 5424 - protein, 216 aa, Papaver somniferum
MSKLQSEVLREAISQINTEATAKKRKFTETVELQIGLKNYDPQKDKRFSGSVKLPHIPRPKMKVCMLGDAQHVEEAQKIGLEYMDVEGLKKLNKNKKLVKKLAKKFHAFLASEAVIKQIPRLLGPGLNKAGKFPTLVTHQESLEAKVNETKAMVKFQLKKVLCMGVAVGNLGMEEKQIFQNVQLSVNFLVSLLKKNWQNVRCLYLKSTMGKPVRIF

SEQ ID NO: 5425 - protein, 216 aa, Aristolochia fimbriata
MSKLQSDVLREAIGQVMADAKERKRNFTETIELQIGLKNYDPQKDKRFSGSVKLPHIPRPKMKVCMLGDAQHVEEAEKIGMDYMDVEGLKKLNKNKKLVKKLAKKYHAFLASEAIIKQIPRLLGPGLNKAGKFPTLVTHQESLESKVNETKAMVKFQLKKVLCMGVAVGNCGMEEKQVFQNIQLSVNFLVSLLKKNWQNVRCLYIKRTMGKPYRVF

SEQ ID NO: 5426 - protein, 216 aa, Theobroma cacao
MSKLQSDALREAISTIVAQSKEKNRKFTETIELQIGLKNYDPQKDKRFSGSVKLPHIPRPKMKICMLGDAQHVEEAEKIGLDYMDVEALKKLNKNKKLVKKLAKKYQAFLASEAIIKQIPRLLGPGLNKAGKFPTLVTHQESLESKVNETKAMVKFQLKKVLCMGVAVGNVAMEEKQIFQNVQMSVNFLVSLLKKNWQNVRCLYLKSTMGPSNRIF

SEQ ID NO: 5427 - protein, 216 aa, Cyamopsis tetragonoloba
MSKLQSDALREAISGIMTDSKEKNRKFVETIELQIGLKNYDPQKDKRFSGSVKLPHIPRPKMKICMLGDAQHVEEAEKIGLDYMDVEALKKLNKNKKLVKKLAKKYHAFLASEAVIKQIPRLLGPGLNKAGKFPTLVTHQESLESKVNETKAMVKFQLKKVLCMGVAVGNVSMEEKQIFQNVQMSVNFLVSLLKKNWQNVRCLYLKSTMGKSYRVF

SEQ ID NO: 5428 - protein, 216 aa, Cycas rumphii
MSKLQGDVLREAIAQVMADSKEKKRKFSETIELQIGLKNYDPQKDKRFSGSVKLPHIPRPKMKVCMLGDAQHVEEAEKIGLDYMDVEGLKKMNKNKKLVKKLAKKYHAFLASEAIIKQIPRLLGPGLNKAGKFPTLVSHQESLEAKVNETKAMVKFQLKKVLCMGVAVGNCGMEEKQIFQNVQLSVNFLVSLLKKNWQNVRCLYLKSTMGKPNRIF

SEQ ID NO: 5429 - protein, 216 aa, Panax ginseng
MSKLQSEALREAITQITNEAKEKKRNFTETIELQIGLKNYDPQKDKRFSGSVKLPHIPRPKMKVCMLGDAQHVEEAEKIGLEYMDVEGLKKLNKNKKLVKKLAKKYHAFLASEAVIKQIPRLLGPGLNKAGKFPTLITHQESLESKVNETKATVKFQLKKVLCMGVAVGNLSMEEKQIFQNVQMSVNFLVSLLKKNWQNARCLYLKSTMGKTVRIF

SEQ ID NO: 5430 - protein, 208 aa, Leymus cinereus x Leymus triticoides
VKDAITQIVGEAREKKRKFTETVELQIGLKNYDPQKDKRFSGSVKLPHIPRPKMRVCMLGDAQHVDQAEKMGLDYMDVESLKKMNKNKKLVKKLAKKYHAFLASEAIIKQIPRLLGPGLNKAGKFPTLVSHQESLEAKVNETKATVKFQLKKVLCMGVAVGNLSMDEKQIQQNIQMSVNFLVSLLKKNWQNVRCLYVKSTMGKRVRVF

SEQ ID NO: 5431 - protein, 216 aa, Glycyrrhiza uralensis
MSKLQSDALREAISGIMADSKEKNRKFVETIELQIGLKNYDPQKDKRFSGSVKLPHIPRPKMKICMLGDAQHVEEAEKIGLDYMDVEALKKLNKNKKLVKKLAKKYHAFLASEAVIKQIPRLLGPGLNKAGKFPTLVTHQESLESKVNETKAMVKFQLKKVLCMGVAVGNVSMEEKQIFQNVQMSVNFLVSLLKKNWQNVRCLYLKSTMGKSYRVF

SEQ ID NO: 5432 - protein, 216 aa, Liriodendron tulipifera
MSKLQSEALREAITQLVSDAKEKKRNFTETIELQIGLKNYDPQKDKRFSGSVKLPHIPRPKMKVCMLGDAQHVEEAERIGLDYMDVEGLKRMNKNKKLVKKLAKKYHAFLASEAIIKQIPRLLGPGLNKAGKFPTLVSHQESLEAKVNETKAMVKFQLKKVLCMGVAVGNCGMEEKQIFQNVQLSVNFLVSLLKKNWQNVRCLYLKSTMGKPNRIF

SEQ ID NO: 5433 - protein, 216 aa, Nuphar advena
  misc_feature (175)..(175): Xaa can be any naturally occurring amino acid
MSKLQSDALREAITQVVGESRDKKRKFTETIELQIGLKNYDPQKDKRFSGSVKLPHIPRPKMKVCMLGDAQHVEEAEKIGLDYMDVEGLKKMNKNKKLVKKLAKKYHAFLASEAIIKQIPRLLGPGLNKAGKFPTLVSHQESLESKVNETKAMVKFQLKKVLCMGVAVGNCAMEXKQIFQNVQLSVNFLVSLLKKNWQNVRCLYLKSTMGRAIRVF

SEQ ID NO: 5434 - protein, 216 aa, Avena sativa
MSKLSSDAVKEAITQIVGEAREKKRKFTETVELQIGLKNYDPQKDKRFSGSVKLPHIPRPKMRVCMLGDAQHVDQAEKLGLDSMDVESLKKMNKNKKLVKKLAKKYHAFLASEAIIKQIPRLLGPGLNKAGKFPTLVSHSESLEAKVNETKATVKFQLKKVLCMGVAVGNLSMDEKQIQQNLQMSVNFLVSLLKKNWQNVRCLYVKSTMGKRIRVF

SEQ ID NO: 5435 - protein, 216 aa, Unknown
  Sequence found in Organisms: Sorghum bicolor, Saccharum officinarum
MSKLQSDALREAIASITNDSREKQRKFVETIELQIGLKNYDPQKDKRFSGSVKLPHIPRPKMKVCMLGDAQHVEEAERIGLDSMDVEALKKMNKNKKLVKKLAKKYHAFLASEAIIKQIPRLLGPGLNKAGKFPTLVTHQESLESKVNETKATVKFQLKKVLCMGVAVGNCGMEEKQIFQNVQMSVNFLVSLLKKNWQNVRCLYLKSTMGKVYRVF

SEQ ID NO: 5436 - protein, 216 aa, Zamia vazquezii
MSKLQSDVLREAITQVVTDSKEKKRKFSETIELQIGLKNYDPQKDKRFSGSVKLPHIPRPKMKVCMLGDAQHVEEAEKIGLDYMDVEGLKKMNKNKKLVKKLAKKYHAFLASEAIIKQIPRLLGPGLNKAGKFPTLVSHQESLEAKVNETKAMVKFQLKKVLCMGVAVGNCGMEEKQVFQNVQLSVNFLVSLLKKNWQNVRCLYLKSTMGKPNRIF

SEQ ID NO: 5437 - protein, 216 aa, Eschscholzia californica
MSKLQSEVLREAITQITADAKEKARKFTETVELQIGLKNYDPQKDKRFSGSVKLPHIPRPKMKVCMLGDAQHVEEAEKIGLDYMDVEGLKKLNKNKKLVKKLAKKFHAFLASEAVIKQIPRLLGPGLNKAGKFPTLVSHQESLEAKVNETKAMVKFQLKKVLCMGVAVGNLGMEEKQIFQNVQLSVNFLVSLLKKNWQNVRCLYLKSTMGKPVRIF

SEQ ID NO: 5438 - protein, 135 aa, Amorphophallus konjac
MSKLQSDVLREAITQLVTSSNEKKRKFTETIELQIGLKNYDPQKDKRFSGSVKLPHIPRPKMKVCMLGDAQHVEEAEKMGLDYMDVEGLKKMNKNKKLVKKLAKKYHAFLASEAIIKQIPRLLGPGLNKAGSFQP

SEQ ID NO: 5439 - protein, 155 aa, Primula obconica
MKVCMLGDAQHVGEAEKIGLEYMDVESLKKLNKNKKLVKKLAKKYHAFLASEAVIKQIPRLLGPGLNKAGKFPTLVSHQESLESKVNETKATVKFQLKKVLCMGVAVGNCGMEEKQIFQNVQMSVNFLVSLLKKNWQNVRCLYLKSTMGKPVRVF

SEQ ID NO: 5440 - protein, 217 aa, Tabernaemontana elegans
MSKLQSDAVREAISQIVSDSKGEKKRKFTETIELQIGLKNYDPQKDKRFSGSVKLPHIPRPKMKICMLGDAQHVEEAEKIGLEYMDVEGLKKLNKNKKLVKKLAKKYHAFLASEAVIKQIPRLLGPGLNKAGKFPTLVTHQESLESKVNETKATVKFQLKKVLCMGVAVGNLDMEEKQIFQNVQMSVNFLVSLLKKNWQNVRCLYLKSTMGRPQRIF

SEQ ID NO: 5441 - protein, 217 aa, Citrus sinensis
MSKLQSDALREAISSIVQYSKETKKRNFTETIELQIGLKNYDPQKDKRFSGSVKLPHIPRPKMKVCMLGDAQHVEEAEKIGLDYMDVEGLKKLNKNKKLVKKLAKKYHAFLASESVIKQIPRLLGPGLNKAGKFPTLVTHQESLESKVNETKATVKFQLKKVLCMGVAVGNLSMEEKQIFQNVQMSVNFLVSLLKKNWQNVRCLYLKSTMGPSNRIF

SEQ ID NO: 5442 - protein, 164 aa, Eragrostis curvula
MKVCMLGDAQHVEEAEKMGLDYMDVESLKKMNKNKKLVKKLAKKYHAFLASEAIIKQIPRLLGPGLNKAGKFPTLVSHQESLESKVNETKATVKFQLKKVLGMGVAVGNLSMDEQQIQQNIQMSVTFLGVPSAEELAHCHVPVHSEHMGNPYRWSSYCAPCEVE

SEQ ID NO: 5443 - protein, 53 aa, Pennisetum glaucum
MGVAVGNLSMEEKQIQQNIQMSVNFLVSLLKKNWQNVRCLYIKSTMGKPNRVF

SEQ ID NO: 5444 - protein, 216 aa, Bupleurum chinense
MSKLQSEALREAISQITKEAVEKKRNFTETIELQIGLKNYDPQKDKRFSGSVKLPHIPRPKMKVCMLGDAQHVGEAEKIGLEYMDVEGLKKLNKNKKLVKKLAKKYHAFLASEAVIKQIPRLLGPGLNKAGKFPTLVSHQESLEAKVNETKATVKFQLKKVLCMGVAVGNCSMEEKQIFQNVQMSVNFLVSLLKKNWQNVRCLYLKSTMGKTVRIF

SEQ ID NO: 5445 - protein, 216 aa, Catharanthus roseus
MSKLQSDALREAISQIKNDADAKKRNFTETVELQIGLKNYDPQKDKRFSGSVRLPHIPRPKMKVCMLGDAQHVEEAEKIGLEYMDVEGLKKLNKNKKLVKKLAKKYHAFLASEAVIKQIPRLLGPGLNKAGKFPTLVTHQESLESKVNETKATVKFQLKKVLCMGVAVGNCAMEEKQIFQNVQMSVNFLVSLLKKNWQNVRCLYLKSTMGKPQRIF

SEQ ID NO: 5446 - protein, 216 aa, Cedrus atlantica
MSKLQSDALREAISQVMADSKEKQRKFTETIELQIGLKNYDPQKDKRFSGSVKLPHIPRPKMKVCMLGDAQHVEEAEKLGLDYMDVEGLKKMNKNKKLVKKLAKKYHAFLASEAIIKQIPRLLGPGLNKAGKFPTLVSHQESLEGKINETKATVKFQLKKVLCMGVAVGNCGMEEKQIFQNVQLSVNFLVSLLKKNWQNVRCLYLKSTMGKTNRIF

SEQ ID NO: 5447 - protein, 216 aa, Unknown
  Sequence found in Organisms: Gossypium hirsutum, Gossypium raimondii
MSKLQSDALREAISTIVANSKEKNRKFTETIELQIGLKNYDPQKDKRFSGSVKLPHIPRPKMKICMLGDAQHVEEAEKIGLDYMDVEALKKLNKNKKLVKKLAKKYHAFLASESVIKQIPRLLGPGLNKAGKFPTLVTHQESLESKVNETKAMVKFQLKKVLCMGVAVGNVAMEEKQIFQNVQMSVNFLVSLLKKNWQNVRCLYLKSTMGPSNRIF

SEQ ID NO: 5448 - protein, 216 aa, Olea europaea
MSKLQSEALREAISVIVTDSKEKNRNFTETIELQIGLKNYDPQKDKRFSGSVKLPHIPRPKMKICMLGDAQHVEEAEKIGLESMDVEALKKLNKNKKLVKKLAKKYHAFLASEAVIKQIPRLLGPGLNKAGKFPTLVSHQESLESKVNETKATVKFQLKKVLCMGVAVGNLGMEEKQVFQNVQMSVNFLVSLLKKNWQNVRCLYLKSTMGKPQRIF

SEQ ID NO: 5449 - protein, 216 aa, Platanus occidentalis
MSKLQSDVLREAIGQVMGAAKEKNRKFTETLELQIGLKNYDPQKDKRFSGSVKLPHIPRPKMKVCMLGDAQHVEEAERIGLESMDVEALKKMNKNKKLVKKLAKKYHAFLASEAIIKQIPRLLGPGLNKAGKFPTLVSHQESLESKVNETKAMVKFQLKKVLCMGVAVGNCGMDEKQVFQNVQLSVNFLVSLLKKNWQNVRCLYLKSTMGKPYRIF

SEQ ID NO: 5450 - protein, 216 aa, Papaver somniferum
MSKLQSEVLREAISQIGTEAKDKKRKFTETVELQIGLKNYDPQKDKRFSGSVKLPHIPRPKMKVCMLGDAQHVEEAQKIGLEYMDVEGLKKLNKNKKLVKKLAKKFHAFLASEAVIKQIPRLLGPGLNKAGKFPTLVTHQESLEAKVNETKAMVKFQLKKVLCMGVAVGNLGMEDKQIFQNVQLSVNFLVSLLKKNWQNVRCLYLKSTMGKPVRIF

SEQ ID NO: 5451 - protein, 216 aa, Papaver somniferum
MSKLQSEVLREAISQINTEATTKKRNFTETVELQIGLKNYDPQKDKRFSGSVKLPHIPRPKMKVCMLGDAQHVEEAQKIGLEYMDVEGLKKLNKNKKLVKKLAKKFHAFLASEAVIKQIPRLLGPGLNKAGKFPTLVTHQESLEAKVNETKAMVKFQLKKVLCMGVAVGNLGMEEKQIFQNVQLSVNFLVSLLKKNWQNVRCLYLKSTMGKPVRIF

SEQ ID NO: 5452 - protein, 216 aa, Pteridium aquilinum
MSKLQSDALREAISTIVAQVQGKNRKFTETIELQIGLKNYDPQKDKRFSGSVKLPHIPRPKMKICMLGDAQHVEEAEKIGLDYMDVEALKKLNKNKKLVKKLAKKYQAFLASEAIIKQIPRLLGPGLNKAGKFPTLVTHQESLESKVNETKAMVKFQLKKVLCMGVAVGNVAMEEKQIFQNVQMSVNFLVSLLKKNWQNVRCLYLKSTMGPSNRIF

SEQ ID NO: 5453 - protein, 216 aa, Sarracenia psittacina
MSKLQSDALREAITQIANDAKEKKRNFTETIELQIGLKNYDPQKDKRFSGSVKLPHIPRPKMKVCMLGDAQHVEEAEKIGLEYMDVEGLKKLNKNKKLVKKLAKKYHAFLASEAVIKQIPRLLGPGLNKAGKFPTLVSHQESLESKVNETKATVKFQLKKVLCMGVAVGNCSMEEKQIFQNVQMSVNFLVSLLKKNWQNVRCLYLKSTMGKPVRIF

SEQ ID NO: 5454 - protein, 216 aa, Thalictrum flavum
MSKLQSDVLREAITQVTGEAKEKKRKFTETVELQIGLKNYDPQKDKRFSGSVKLPHIPRPKMKICMLGDAQHVEEAEKIGLEYMDVEGLKKLNKNKKLVKKLAKKYHAFLASEAVIKQIPRLLGPGLNKAGKFPTLVTHQESLESKVNESKAMVKFQLKKVLCMGVAVGNLGMDEKQIFQNVQLSVNFLVSLLKKNWQNVRCLYLKSSMGKPFRIF

SEQ ID NO: 5455 - protein, 216 aa, Cryptomeria japonica
MSKLQSDVLREAITGLVGESKEKNRKFVETIELQIGLKNYDPQKDKRFSGSVKLPHIPRPKMKLCMLGDAQHVEEAEKIGLDYMDVEGLKKMNKNKKLVKKLAKKYHAFLASEAIIKQIPRLLGPGLNKAGKFPTLVSHQESLEGKVNETKATIKFQLKKVLCMGVAVGNCGMDEKQIFQNVQLSVNFLVSLLKKNWQNVRCLYLKSTMGKPSRVF

SEQ ID NO: 5456 - protein, 216 aa, Medicago truncatula
MSKLQSDVLREAITGLVGESKEKNRKFVETIELQIGLKNYDPQKDKRFSGSVKLPHIPRPKMKLCMLGDAQHVEEAEKIGLDYMDVEGLKKMNKNKKLVKKLAKKYHAFLASEAIIKQIPRLLGPGLNKAGKFPTLVSHQESLEGKVNETKATIKFQLKKVLCMGVAVGNCGMEEKQIFQNAQLSVNFLVSLLKKNWQNVRCLYLKSTMGKPSRIF

SEQ ID NO: 5457 - protein, 216 aa, Carica papaya
MSKLQSDALREAISTVVNASKEKKRNFTETIELQIGLKNYDPQKDKRFSGSVKLPHIPRPKMKVCMLGDAQHVEEAEKIGLDYMDVEGLKKLNKNKKLVKKLAKKYHAFLASESVIKQIPRLLGPGLNKAGKFPTLVTHQESLESKVNEIKATVKFQLKKVLCMGVAVGNCAMEEKQIFQNVQMSVNFLVSLLKKNWQNVRCLYLKSTMGPSNRVF

SEQ ID NO: 5458 - protein, 216 aa, Glycine max
MSKLQSDALREAISGIMTDSKEKNRKFVETIELQIGLKNYDPQKDKRFSGSVKLPHIPRPKMKICMLGDAQHVEEAEKIGLDYMDVEALKKLNKNKKLVKKLAKKYHAFLASEAVIKQIPRLLGPGLNKAGKFPTLVTHQESLESKVNETKAMVKFQLKKVLCMGVAVGNVSMEEKQIFQNVQLSVNFLVSLLKKNWQNVRCLYLKSTMGKSYRVF

SEQ ID NO: 5459 - protein, 216 aa, Glycine max
MSKLQSDALREAISGIMADSKEKNRKFVETIELQIGLKNYDPQKDKRFSGSVKLPHIPRPKMKICMLGDAQHVEEAEKIGLDYMDVEALKKLNKNKKLVKKLAKKYHAFLASEAVIKQIPRLLGPGLNKAGKFPTLVTHQESLESKVNETKAMVKFQLKKVLCMGVAVGNVSMEEKQIFQNVQLSVNFLVSLLKKNWQNVRCLYLKSTMGKSYRVF

SEQ ID NO: 5460 - protein, 216 aa, Eschscholzia californica
MSKLQSEVLREAITQISGDAKEKARKFTETVELQIGLKNYDPQKDKRFSGSVKLPHIPRPKMKVCMLGDAQHVEEAEKIGLDYMDVEGLKKLNKNKKLVKKLAKRFHAFLASEAVIKQIPRLLGPGLNKAGKFPTLVSHQESLEAKVNETKAMVKFQLKKVLCMGVAVGNLGMEEKQIFQNVQLSVNFLVSLLKKNWQNVRCLYLKSTMGKPVRIF

SEQ ID NO: 5461 - protein, 113 aa, Catharanthus roseus
MSKLQSDAVREAISTIVTDCKEVKKRKFTETIELQIGLKNYDPQKDKRFSGSVKLPHIPRPKMKVCMLGDAQHVEEAEKIGLEYMDVEGLKKLKQKQEVSEKACQEVSCFPCI

SEQ ID NO: 5462 - protein, 216 aa, Amsonia hubrichtii
MSKLQSDALREAISVVKNDAAEKKRNFTETIELQIGLKNYDPQKDKRFSGSVKLPHIPRPKMKACMLGDAQHVEEAEKIGLEYMDVEGLKKLNKNKKLVKKLAKKYHAFLASEAVIKQIPRLLGPGLNKAGKFPTLVTHQESLESKVNEIKATVKFQLKKVLCMGVAVGNCDMEEKQIFQNVQMSVNFLVSLLKKNWQNVRCLYLKSTMGKPQRIF

SEQ ID NO: 5463 - protein, 216 aa, Beta vulgaris
MSKLQGEAVREAISGIANDAKEKNRKFTETIELQIGLKNYDPQKDKRFSGSVKLPHIPRPKMKVCMLGDAQHVEEAERIGLEWMDVEALKKLNKNKKLVKKLAKKYHAFLASEAVIKQIPRLLGPGLNKAGKFPTLVTHQEPLENKVNEIKATVKFQLKKVLCMGVAVGNCSMEEKQIFQNVQMSVNFLVSLLKKNWQNVRCLYLKSTMGKPYRIF

SEQ ID NO: 5464 - protein, 216 aa, Unknown
  Sequence found in Organisms: Brassica napus, Brassica juncea, Brassica rapa
MSKLQSEVLREGITAVKGKADEKKRNFVETVELQIGLKNYDPQKDKRFSGSVKLPHIPRPKMKICMLGDAQHVEEAEKIGLDYMDVEALKKLNKNKKLVKKLAKKYHAFLASESVIKQIPRLLGPGLNKAGKFPTLVSHQESLEGKVNETKATVKFQLKKVLCMGVAVGNLSMEEKQLFQNVQMSVNFLVSLLKKNWQNVRCLYLKSTMGPPQRIF

SEQ ID NO: 5465 - protein, 216 aa, Cephalotaxus harringtonia
MSKLQSDVLREAITGVVAESKEKKRKFVETLELQIGLKNYDPQKDKRFSGSVKLPHIPRPKMKLCMLGDAQHIEEAEKIGLDYMDVEGLKKMNKNKKLVKKLAKKYHAFLASEAIIKQIPRLLGPGLNKAGKFPTLVSHQESLEGKVNETKATIKFQLKKVLCMGVAVGNCGMEEKQIFQNVQLSVNFLVSLLKKNWQNVRCLYLKSTMGKPSRIF

SEQ ID NO: 5466 - protein, 216 aa, Unknown
  Sequence found in Organisms: Gossypium hirsutum, Gossypium raimondii
MSKLQSDALREAISTIVAQSKEKQRKFTETIELQIGLKNYDPQKDKRFSGSVKLPHIPRPKMKICMLGDAQHVEEAEKIGLDYMDVEALKKLNKNKKLVKKLAKKYHAFLASESVIKQIPRLLGPGLNKAGKFPTLVTHQESLESKVNETKAMVKFQLKKVLCMGVAVGNVAMEEKQIFQNVQMSVNFLVSLLKKNWQNVRCLYLKSTMGPSNRIF

SEQ ID NO: 5467 - protein, 216 aa, Gossypium hirsutum
MSKLQSDALREAISTIVTQSKEKQRKFTETIELQIGLKNYDPQKDKRFSGSVKLPHIPRPKMKICMLGDAQHVEEAEKIGLDYMDVEALKKLNKNKKLVKKLAKKYHAFLASESVIKQIPRLLGPGLNKAGKFPTLVTHQESLESKVNETKAMVKFQLKKVLCMGVAVGNVAMEEKQIFQNVQMSVNFLVSLLKKNWQNVRCLYLKSTMGPSNRIF

SEQ ID NO: 5468 - protein, 216 aa, Eschscholzia californica
MSKLQSDVLREAITQIVGDAKEKKRNFTETIELQIGLKNYDPQKDKRFSGSVKLPHIPRPKMKVCMLGDAQHVEEAEKIGLAYMDVESLKKLNKNKKLVKKLAKKYHAFLASEAVIKQIPRLLGPGLNKAGKFPTLVSHQESLEAKVNETKAMVKFQLKKVLCMGVAVGNLGMEEKQIFQNVQLSVNFLVSLLKKNWQNVRCLYLKSTMGKTNRIF

SEQ ID NO: 5469 - protein, 216 aa, Eucalyptus grandis
MSKLQSDALREAISGIFSDCNEKKRKFTETIELQIGLKNYDPQKDKRFSGSVKLPHIPRPKMKVCMLGDAQHVEEAEKIGLAYMDVEALKKLNKNKKLVKKLAKKYHAFLASEAVIKQIPRLLGPGLNKAGKFPTLVTHQESLESKVNETKAMVKFQLKKVLCMGVAIGNLSMEEKQVFQNVQLSVNFLVSLLKKNWQNVKCLHLKSTMGKPYRVF

SEQ ID NO: 5470 - protein, 216 aa, Fagopyrum esculentum
MSKLQSEALREAISGIVNDTKEKARKFTETIELQIGLKNYDPQKDKRFSGSVKLPHIPRPKMKVCMLGDAQHVEESEKMGLDYMDVEALKKLNKNKKLVKKLAKKYHAFLASESVIKQIPRLLGPGLNKAGKFPTLVSHQESLESKVNEIKATVKFQLKKVLCMGVAVGNCGMEEKQIFQNVQMSVNFLVSLLKKNWQNVRCLYLKSTMGKPYRIF

SEQ ID NO: 5471 - protein, 216 aa, Fraxinus spp
MSKLQSEALREAVSVIVTDSKEKKRNFTETIELQIGLKNYDPQKDKRFSGSVKLPHIPRPKMKICMLGDAQHVEEAEKIGLESMDVEALKKLNKNKKLVKKLAKKYHAFLASEAVIKQIPRLLGPGLNKAGKFPTLVSHQESLESKVNETKATVKFQLKKVLCMGVAVGNLGMEEKQIFQNVQMSVNFLVSLLKKNWQNVRCLYLKSTMGKPQRIF

SEQ ID NO: 5472 - protein, 216 aa, Olea europaea
MSKLQSEALREAISVIVTDSKEKKRNFTETIELQIGLKNYDPQKDKRFSGSVKLPHIPRPKMKICMLGDAQHVEEAEKIGLESMDVEALKKLNKNKKLVKKLAKKYHAFLASEAVIKQIPRLLGPGLNKAGKFPTLVSHQESLESKVNETKATVKFQLKKVLCMGIAVGNLGMEEKQIFQNVQMSVNFLVSLLKKNWQNVRCLYLKSTMGKPQRIF

SEQ ID NO: 5473 - protein, 216 aa, Papaver somniferum
MSKLQSEVLREAISQINTEATAKKRNFTETVELQIGLKNYDPQKDKRFSGSVKLPHIPRPKMKVCMLGDAQHVEEAQKIGLEYMDVEGLKKLNKNKKMVKKLAKKFHAFLASEAVIKQIPRLLGPGLNKAGKFPTLVTHQESLEAKVNETKAMVKFQLKKVLCMGVAVGNLGMEEKQIFQNVQLSVNFLVSLLKKNWQNVRCLYLKSTMGKPVRIF

SEQ ID NO: 5474 - protein, 216 aa, Papaver somniferum
MSKLQSEVLREAISQIGTEAKDKKRNFTETMELQIGLKNYDPQKDKRFSGSVKLPHIPRPKMKVCMLGDAQHVEEAQKIGLDYMDVEGLKKLNKNKKLVKKLAKKFHAFLASEAVIKQIPRLLGPGLNKAGKFPTLVTHQESLEAKVNETKAMVKFQLKKVLCMGVAVGNLGMEDKQIFQNVQLSVNFLVSLLKKNWQNVRCLYLKSTMGKPVRIF

SEQ ID NO: 5475 - protein, 217 aa, Scabiosa columbaria
MSKLQSEALREAISQIATAAAGENKRNFVETIELQIGLKNYDPQKDKRFSGSVKLPHIPRPKMKVCMLGDAQHVEEAEKIGLEYMDVEGLKKLNKNKKLVKKLAKKYHAFLASEAVIKQIPRLLGPGLNKAGKFPTLVTHQESLESKVNEIKATVKFQLKKVLCMGVAVGNCSMEEKQIFQNVQMSVNFLVSLLKKNWQNVRCLYLKSTMGKPVRIF

SEQ ID NO: 5476 - protein, 217 aa, Unknown
  Sequence found in Organisms: Thellungiella halophila, Eutrema halophilum
MSKLQSEALREAISAIVTHCKETKPRKFTETIELQIGLKNYDPQKDKRFSGSVKLPHIPRPKMKICMLGDAQHVEEAEKIGLDSMDVEALKKLNKNKKLVKKLAKKFQAFLASESVIKQIPRLLGPGLNKAGKFPTLVSHQESLESKVNETKATVKFQLKKVLCMGVAVGNLGMEEKQIFQNVQMSVNFLVSLLKKNWQNVRCLYLKSTMGPPNRVF

SEQ ID NO: 5477 - protein, 216 aa, Antirrhinum majus
MSKLQSEALREAITVITADAKEKKRNFTETVELQIGLKNYDPQKDKRFSGSVKLPHIPRPKMKICMLGDAQHVEEAAKIGLESMDVEALKKLNKNKKLVKKLAKKYHAFLASEAVIKQIPRLLGPGLNKAGKFPTLVSHQESLESKVNETKATVKFQLKKVLCMGVAVGNLGMEEKQIFQNVQMSVNFLVSLLKKNWQNVRCLYLKSTMGKPQRIF

SEQ ID NO: 5478 - protein, 216 aa, Ocimum basilicum
MSKLSGDATREAISQIVSECKEKKRNFTETIELQIGLKNYDPQKDKRFSGSVKLPHIPRPKMKICMLGDAQHVEEAEKIGMESMDVEALKKLNKNKKLVKKLAKKYHAFLASEAVIKQIPRLLGPGLNKAGKFPTLVSHQESLESKVNETKATVKFQLKKVLCMGVAVGNLDMEEKQIFQNVQMSVNFLVSLLKKNWQNVRCLYLKSTMGKPQRIF

SEQ ID NO: 5479 - protein, 217 aa, Catharanthus roseus
MSKLQSDAVREAISTIVTDCKEVKKRKFTETIELQIGLKNYDPQKDKRFSGSVKLPHIPRPKMKVCMLGDAQHVEEAEKIGLEYMDVEGLKKLNKNKKLVKKLAKKYHAFLASEAVIKQIPRLLGPGLNKAGKFPTLVTHQESLESKVNETKATVKFQLKKVLCMGVAVGNLDMEEKQIFQNVQMSVNFLVSLLKKNWQNVRCLYLKSTMGRPQRIF

SEQ ID NO: 5480 - protein, 215 aa, Cenchrus ciliaris
SKLQSDVLREAIASVTNDAREKQRKFVETIELQIGLKNYDPQKDKRFSGSVKLPHIPRPKMKVCMLGDAQHVEEAARIGLDSMDVEALKKMNKNKKLVKKLAKKYHAFLASEAIIKQIPRLLGPGLNKAGKFPTLVSHQESLESKVNETKATVKFQLKKVLCMGVAVGNCGMDEKQIFQNVQMSVNFLVSLLKKNWQNVRCLYLKSTMGKVYRLF

SEQ ID NO: 5481 - protein, 217 aa, Unknown
  Sequence found in Organisms: Citrus clementina, Citrus sinensis
MSKLQSDALREAVSSIVQYSKETKKRNFTETIELQIGLKNYDPQKDKRFSGSVKLPHIPRPKMKVCMLGDAQHVEEAEKIGLDYMDVEGLKKLNKNKKLVKKLAKKYHAFLASESVIKQIPRLLGPGLNKAGKFPTLVTHQESLESKVNETKATVKFQLKKVLCMGVAVGNLSMEEKQIFQNVQMSVNFLVSLLKKNWQNVRCLYLKSTMGPSNRIF

SEQ ID NO: 5482 - protein, 216 aa, Gossypium hirsutum
MSKLQSDALREAISTIVANSKEKSRKFTETIELQIGLKNYDPQKDKRFSGSVKLPHIPRPKMKICMLGDAQHVEEAEKIGLDYMDVEALKKLNKNKKLVKKLAKKYHAFLASESVIKQIPRLLGPGLNKAGKFPTLVTHQESLESKVNETKAMVKFQLKKVLCMGVAVGNVAMEEKQIFQNVQMSVNFLVSLLKKNWQNVRCLYLKSTMGPSNRIF

SEQ ID NO: 5483 - protein, 216 aa, Vigna unguiculata
MSKLQSDALREAITGIMGDSKEKNRKFVETIELQIGLKNYDPQKDKRFSGSVKLPHIPRPKMKICMLGDAQHVEEAEKIGLDYMDVEALKKLNKNKKLVKKLAKKYHAFLASEAVIKQIPRLLGPGLNKAGKFPTLVTHQESLESKVNETKAMVKFQLKKVLCMGVAVGNVSMEEKQIFQNVQLSVNFLVSLLKKNWQNVRCLYLKSTMGKSYRVF

SEQ ID NO: 5484 - protein, 216 aa, Adiantum capillus-veneris
MSKLQSDVLREAITQLVSESKEKKRKFVETVELQIGLKNYDPQKDKRFSGSVKLAHIPRPKMKVCMLGDAQHVEEAEKIGLDCMDVDALKKMNKNKKLVKKLAKKYHAFLASEAVIKQIPRLLGPGLNKAGKFPTLVSHQESLEGKLNETKATVKFQLKKVLCMGVAVGNLEMEEKQLFQNVQLSVNFLVSLLKKNWQNVRVLYLKSTMGKPQRIF

SEQ ID NO: 5485 - protein, 216 aa, Vitis vinifera
MSKLQSDALREAITNIVNESKEKKRNFTETIELQIGLKNYDPQKDKRFSGSVKLPHIPRPKMKVCMLGDAQHVEEAEKIGLEYMDVEGLKKLNKNKKLVKKLAKKYHAFLASEAVIKQIPRLLGPGLNKAGKFPTLVTHQESLESKVNETKAMVKFQLKKVLCMGVAVGNCSMEEKQIFQNVQLSVNFLVSLLKKNWQNVRCLYLKSTMGRSNRVF

SEQ ID NO: 5486 - protein, 216 aa, Vitis vinifera
MSKLQSEALREAITQIVGDAKEKKRNFIETIELQIGLKNYDPQKDKRFSGSVKLPHIPRPKMKICMLGDAQHVEEAEKIGLEYMDVEGLKKLNKNKKLVKKLAKKYHAFLASEAVIKQIPRLLGPGLNKAGKFPTLVTHQESLESKVNETKAMVKFQLKKVLCMGVAVGNCSMEEKQIFQNVQLSVNFLVSLLKKNWQNVRCLYLKSTMGKSNRIF

SEQ ID NO: 5487 - protein, 216 aa, Heritiera littoralis
MSKLQSDALREAISTIVAQSKERQRKFTETIELQIGLKNYDPQKDKRFSGSVKLPHIPRPKMKICMLGDAQHVEEAEKIGLDYMDVEALKKLNKNKKLVKKLAKKYHAFLASESVIKQIPRLLGPGLNKAGKFPTLVTHQESLESKVNETKAMVKFQLKKVLCMGVAVGNVAMEEKQIFQNVQMSVNFLVSLLKKNWQNVRCLYLKSTMGPSNRVF

SEQ ID NO: 5488 - protein, 216 aa, Lolium multiflorum
MSKLSSDAVKEAIALIVGEAREKKRKFTETVELQIGLKNYDPQKDKRFSGSVKLPHIPRPKMRVCMLGDASHVDQAEKLGLDSMDVESLKKMNKNKKLVKKLAKKYHAFLASEAIIKQIPRLLGPGLNKAGKFPTLVSHSESLEAKVNETKATVKFQLKKVLCMGVAVGNLSMDEKQIQQNLQMSVNFLVSLLKKNWQNVRCLYVKSTMGKRQRVF

SEQ ID NO: 5489 - protein, 216 aa, Arachis hypogaea
MSKLQSDALREAITGIVADSKEKNRKFVETIELQIGLKNYDPQKDKRFSGSVKLPHIPRPKMKICMLGDAQHVEEAEKIGLDWMDVEALKKLNKNKKLVKKLAKKYHAFLASEAVIKQIPRLLGPGLNKAGKFPTLVTHQESLESKVNETKAMVKFQLKKVLCMGVAVGNVSMEEKQIFQNVQLSVNFLVSLLKKNWQNVRCLYLKSTMGKSYRVF

SEQ ID NO: 5490 - protein, 216 aa, Petunia hybrida
MSKLQSDALREAISVIKNDSNEKKRKFTETVELQIGLKNYDPQKDKRFSGSVKLPHIPRPKMKICMLGDAQHVEEAEKIGLEYMDVEGLKKLNKNKKLVKKLAKKYHAFLASEAVIKQIPRLLGPGLNKAGKFPTLVTHQESLESKVNETKATIKFQLKKVLCMGVAVGNLDMEEKQIFQNVQMSVNFLVSLLKKNWQNVRCLYLKSTMGKTQRIF

SEQ ID NO: 5491 - protein, 216 aa, Podocarpus macrophillus
MSKLQSDVLRESITQIMNDSKEKKRKFSETIELQIGLKNYDPQKDKRFSGSVKLPHIPRPKMKVCMLGDAQHVEEAEKIGLDYMDVEGLKKMNKNKKLVKKLAKKYHAFLASEAIIKQIPRLLGPGLNKAGKFPTLVSHQESLEAKVNETKATVKFQLKKVLCMGVAVGNCGMEEKQVFQNVQMSVNFLVSLLKKNWQNVRCLYLKTTMGKPTRVF

SEQ ID NO: 5492 - protein, 216 aa, Raphanus sativus
MSKLQSEVLREGIAAVKGKADEKKRNFVETVELQIGLKNYDPQKDKRFSGSVKLPHIPRPKMKICMLGDAQHVEEAEKIGLDYMDVEALKKLNKNKKLVKKLAKKYHAFLASESVIKQIPRLLGPGLNKAGKFPTLVSHQESLEGKVNETKATVKFQLKKVLCMGVAVGNLSMEEKQLFQNVQMSVNFLVSLLKKNWQNVRCLYLKSTMGPPQRIF

SEQ ID NO: 5493 - protein, 78 aa, Fraxinus spp
MSKLQSEALREAISVIVTDTKEKKRNFTETIELQIGLKNYDPQKDKRFSGSVKLPHIPRPKMKICMLGDAQHVEEAEK

SEQ ID NO: 5494 - protein, 673 aa, Mimulus guttatus
MEIVRLVFVANLLLLLPILLHSTSAYNVGDPVPLFVNKIGPLHNPSETYKYYELAFCRPDQVLEERESIGEVLNGDRLANALYDLKFAVNKTRAVNCQQKLNKQDISKFRDAIKNDFYYQMYYDDLPLWAFIGKVEDENWTSDSKGPKYYLFTHVQFDALYNGNQVVEIHALSDPNHVLDITDDIDVTIDFTYSIFWNETSIPYRNRMERYLAASSLPILQQTHWFSFVNSIVIVIMLTGLLVVLFTRHLKNDLRKWSIGDEDEEKEVGWKYLHGDVLRCPTNLPLFCAVLGCGTQLLTMIFILFVLAFLGISYPHSHGSLSNSIFISYLLTSAVSGYISSSFCIQYSETGQETSTLLTGTLFLGPFLFTAFILNTLAAYFNVTAALPLGTIFIIILIYTLVAIPLLVLGGVVGKRNKYDIQCSPVAKKSPREIPFLAWYRRTPAQMFIGGLLPFSAIVLELHNLCATVWGYKVYTSLGVLFVTILILVLLTVMISVGLTYFQLVVEDHDWWWRSVLRGGSTAIFMFCYCVYFYYKSNMSGILQACFFFGYSFCMCYAFFLVLGALSFRASLIFVRRIYHAVKSDCPISPSSSCERDLTELENFSLSIFCRKRDKKRIGKMEPAVRRSGGVWEGMYRVIMRRTPVYVTFVVVGAFLGERAVDRGIRGLWDHIN

SEQ ID NO: 5495 - protein, 217 aa, Coffea canephora
MSKLQSDAVREAIGVIMTEAKGDKKRNFTETIELQIGLKNYDPQKDKRFSGSVKLPHIPRPKMKVCMLGDAQHVEEAEKIGLEYMDVEGLKKLNKNKKLVKKLAKKYHAFLASEAVIKQIPRLLGPGLNKAGKFPTLVTHQESLESKVNETKATVKFQLKKVLCMGVAVGNCDMEEKQIFQNVQMSVNFLVSLLKKNWQNVRCLYLKSTMGKPNRIF

SEQ ID NO: 5496 - protein, 217 aa, Raphanus sativus
MSKLQSEAVREAISSIITHCKETKPRKFTETIELQIGLKNYDPQKDKRFSGSVKLPHIPRPKMKICMLGDAQHVEEAEKIGLDSMDVEALKKLNKNKKLVKKLAKKFHAFLASESVIKQIPRLLGPGLNKAGKFPTLVSHQESLESKVNETKATVKFQLKKVLCMGVAVGNLGMEEKQIFQNVQMSVNFLVSLLKKNWQNVRCLYLKSTMGPPNRVF

SEQ ID NO: 5497 - protein, 216 aa, Gossypium hirsutum
MSKLQSDALREAISTIVAQSKEKQRKFIETIELQIGLKNYDPQKDKRFSGSVKLPHIPRPKMKICMLGDAQHVEEAEKIGLDYMDVEALKKLNKNKKLVKKLAKKYHAFLASESVIKQIPRLLGPGLNKAGKFPTLVTHQESLESKVNETKAMVKFQLKKVLCMGVAVGNVAMEEKQIFQNVQMSVNFLVSLLKKNWQNVRCLYLKSTMGPSNRIF

SEQ ID NO: 5498 - protein, 216 aa, Euonymus alatus
MSKLQSDALREAISTIVKECAEKKRNFVQTIELQIGLKNYDPQKDKRFSGSVKLPHIPRPKMKVCMLGDAQHVEEAEKIGLDYMDVEALKKLNKNKKLVKKLAKKHHAFLASESVIKQIPRLLGPGLNKAGKFPTLVSHQESLESKINETKATVKFQLKKVLCMGVAVGNVSMEEKQIFQNVQMSVNFLVSLLKKNWQNVRCLYLKSTMGSPNRIF

SEQ ID NO: 5499 - protein, 216 aa, Setaria italica
MSKLQSDALREAIASVTNDSREKQRKFVETIELQIGLKNYDPQKDKRFSGSVKLPHIPRPKMKVCMLGDAQHVEEAGRIGLDSMDVEALKKMNKNKKLVKKLAKKYHAFLASEAIIKQIPRLLGPGLNKAGKFPTLVSHQESLESKVNETKATVKFQLKKVLCMGVAVGNCGMDEKQIFQNVQMSVNFLVSLLKKNWQNVRCLYLKSTMGKVYRLF

SEQ ID NO: 5500 - protein, 216 aa, Primula obconica
MSKLQSDVLREAITQIHKDSTEKSRKFTETIELQIGLKNYDPQKDKRFSGSVKLPHIPRPKMKVCMLGDAHHINEAEKIGLEYMDVESLKKLNKNKKLVKKLAKKYHAFLASEAVIKQIPRLLGPGLNKAGKFPTLVSQQESLESKVNETKATVKFQLKKVLCMGVAVGNLGMEEKQIFQNVQMSVNFLVSLLKKNWQNVRCLYLKSTMGKPVRVF

SEQ ID NO: 5501 - protein, 68 aa, Secale cereale
MSKLQSEALREAITNIINDCREKNRKFVETIELQIGLKNYDPQKDKRFSGSVKLPHIPRPKDEGLHAW

SEQ ID NO: 5502 - protein, 216 aa, Unknown
  Sequence found in Organisms: Thellungiella halophila, Eutrema halophilum
MSKLQSEALREAITTVKSKSEDKKRNFVETVELQIGLKNYDPQKDKRFSGSVKLPHIPRPKMKICMLGDAQHVEEAEKMGLDYMDVEALKKLNKNKKLVKKLAKKYHAFLASESVIKQIPRLLGPGLNKAGKFPTLVSHQESLESKVNETKATVKFQLKKVLCMGVAVGNLSMEEKQLFQNVQMSVNFLVSLLKKNWQNVRCLYLKSTMGPPQRIF

SEQ ID NO: 5503 - protein, 216 aa, Tripterygium wilfordii
MSKLQSDALREAIATIVKESTEKKRNFVQTIELQIGLKNYDPQKDKRFSGSVKLPHIPRPKMKVCMLGDAQHVEEAEKIGLDYMDVEALKKLNKNKKLVKKLAKKHHAFLASESVIKQIPRLLGPGLNKAGKFPTLVSHQESLESKVNETKATVKFQLKKVLCMGVAVGNVSMEEKQIFQNVQMSVNFLVSLLKKNWQNVRCLYLKSTMGSPNRIF

SEQ ID NO: 5504 - protein, 148 aa, Utricularia gibba
MRSTLKRLEKIGLESMDVEALKKLNKNKKLVKKLAKKYHAFLASEAVIKQIPRLLGPGLNKAGKFPTLVTHQESLESKVNETKATVKFQLKKVLCMGVAVGNLDMEEKQIFQNVQMSVNFLVSLLKKNWQNVRCLYLKSTMGKPQRIF

SEQ ID NO: 5505 - protein, 216 aa, Phaseolus coccineus
MSKLQSDALREAISGIMGDSKEKNRNFVETIELQIGLKNYDPQKDKRFSGSVKLPHIPRPKMKICMLGDAQHVEEAEKIGLDYMDVEALKKLNKNKKLVKKLAKKYHAFLASEAVIKQIPRLLGPGLNKAGKFPTLVTHQESLESKVNETKAMVKFQLKKVLCMGVAVGNVSMDEKQIFQNVQLSVNFLVSLLKKNWQNVRCLYLKSTMGKSYRVF

SEQ ID NO: 5506 - protein, 216 aa, Cenchrus ciliaris
MSKLQSDALRDAIASITNDSREKPRKFVETIELQIGLKNYDPQKDKRFSGSVKLPHIPRPKMKVCMLGDAQHVEEAARIGLDSMDVEALKKMNKNKKLVKKLAKKYHAFLASEAIIKQIPRLLGPGLNKAGKFPTLVSHQESLESKVNETKATVKFQLKKVLCMGVAVGNCGMDEKQIFQNVQMSVNFLVSLLKKNWQNVRCLYLKSTMGKVYRLF

SEQ ID NO: 5507 - protein, 216 aa, Unknown
  Sequence found in Organisms: Cucumis sativus, Cucumis melo
MSKLQSDALREAISSIFADSGEKKRKFTETIELQIGLKNYDPQKDKRFSGSVKLPHIPRPKMKICMLGDASHVEEAEKIGLDYMDVEGLKKLNKNKKLVKKLAKKYHAFLASEAIIKQIPRLLGPGLNKAGKFPTLVTHQESLESKVNETKAMVKFQLKKVLCMGVAVGNIAMEEKQVFQNVQMSVNFLVSLLKKNWQNVRCLYLKSTMGKAYRVF

SEQ ID NO: 5508 - protein, 216 aa, Ipomoea nil
MSKLQSDAVREAISQLMGDSKEKNRKFTETIELQIGLKNYDPQKDKRFSGSVKLPHIPRPKMKVCMLGDAQHVEEAEKIGMEYMDVEGLKKLNKNKKLVKKLAKKYHAFLASEAVIKQIPRLLGPGLNKAGKFPTLVTHQESLETKVNETKATVKFQLKKVLCMGVAVGNVAMEEKQIFQNVQMSVNFLVSLLKKNWQNVRCLYLKTTMGRPIRVF

SEQ ID NO: 5509 - protein, 216 aa, Leymus cinereus x Leymus triticoides
MSKLQSESLREAITNITNDCREKNRKFVETIELQIGLKNYDPQKDKRFSGSVKLPHIPRPKMRVCMLGDAQHVEEAGKMGLDCMDVESLKKMNKNKKLVKKLAKKYHAFLASEAIIKQIPRLLGPGLNKAGKFPTLVSHQESLESKVNETKATVKFQLKKVLCMGVAVGHLGMEEKQIFQNVQMSVNFLVSLLKKNWQNVRCLYLKSTMGKVYRLF

SEQ ID NO: 5510 - protein, 216 aa, Zea mays
MSKLQSDSLRDAIASITNDSREKQRKFVETIELQIGLKNYDPQKDKRFSGSVKLPHIPRPKMKVCMLGDAQHVEEAERMGIDNMDVEALKKMNKNKKLVKKLAKKYHAFLASEAIIKQIPRLLGPGLNKAGKFPTLVTHQESLESKVNETKATVKFQLKKVLCMGVAVGNCGMDEKQIFQNVQMSVNFLVSLLKKNWQNVRCLYLKSTMGKVYRLF

SEQ ID NO: 5511 - protein, 216 aa, Pennisetum glaucum
MSKLQSDVLREAIASITNDAREKQRKFVETIELQIGLKNYDPQKDKRFSGSVKLPHIPRPKMKVCMLGDAQHVEEAGRMGLDSMDVEALKKMNKNKKLVKKLAKKYHAFLASEAIIKQIPRLLGPGLNKAGKFPTLVSHQESLESKVNETKATVKFQLKKVLCMGVAVGNCGMDEKQIFQNVQMSVNFLVSLLKKNWQNVRCLYLKSTMGKVYRLF

SEQ ID NO: 5512 - protein, 216 aa, Momordica charantia
MSKLQSDALREAITSIFSDSNEKKRKFTETIELQIGLKNYDPQKDKRFSGSVKLPHIPRPKMKICMLGDALHVEEAEKIGLDYMDVEGLKKLNKNKKLVKKLAKKYHAFLASEAVIKQIPRLLGPGLNKAGKFPTLVTHQESLESKVNETKAMVKFQLKKVLCMGVAVGNVSMEEKQVFQNVQMSVNFLVSLLKKNWQNVRCLYLKSTMGKSYRVF

SEQ ID NO: 5513 - protein, 216 aa, Mimulus guttatus
MSKLQSDAVREAITQIAADCKEKNRKFTETIELQIGLKNYDPQKDKRFSGSVKLPHIPRPKMKICMLGDAQHVEEATKIGLESMDVEALKKLNKNKKLVKKLAKKYHAFLASEAVIKQIPRLLGPGLNKAGKFPTLVSHQESLEAKVNETKATVKFQLKKVLCMGVAVGNLSMEEKQIFQNVQMSVNFLVSLLKKNWQNVRCLYLKSTMGRPQRVF

SEQ ID NO: 5514 - protein, 216 aa, Tropaeolum majus
MSKLQSEALREAITTIVTASKEKQRKFTETIELQIGLKNYDPQKDKRFSGSVKLPHIPRPKMKACMLGDAQHVEEAEKIGLDYMDVEALKKLNKNKKLVKKLAKKYHAFLASESVIKQIPRLLGPGLNKAGKFPTLVSHQESLEAKVNEIKATVKFQLKKVLCMGVAVGNCAMEEKQIFQNVQMSVNFLVSLLKKNWQNVRCLYLKSTMGPSNRVF

SEQ ID NO: 5515 - protein, 216 aa, Orobanche aegyptiaca
MSKLQNEALREAITQIVADCKEKKRNFIETIELQIGLKNYDPQKDKRFSGSVKLPHIPRPKMKICMLGDAQHVEEAEKIGLESMDVEALKKLNKNKKLVKKLAKKYHAFLASEAVIKQIPRLLGPGLNKAGKFPTLVTHQESLESKVNETKATVKFQLKKVLCMGVAVGNLDMEEKQIFQNVQMSINFLVSLLKKNWQNVKCLYLKSTMGKPQRIF

SEQ ID NO: 5516 - protein, 216 aa, Petunia hybrida
MSKLQSDALREAISVITKDSAEKKRKFTETIELQIGLKNYDPQKDKRFSGSVKLPHIPRPKMKVCMLGDAQHVEEAEKIGLEYMDVEGLKKLNKNKKLVKKLAKKYHAFLASEAVIKQIPRLLGPGLNKAGKFPTLVTHQESLESKVNEIKATVKFQLKKVLCMGVAVGNMDMEEKQIFQNVQMSVNFLVSLLKKNWQNVRCLYSKSTMGKTQRIF

SEQ ID NO: 5517 - protein, 216 aa, Petunia hybrida
MSKLQSDALREAISVIKKASEDKKRKFTETIELQIGLKNYDPQKDKRFSGSVKLPHIPRPKMKICMLGDAQHVEEAEKIGLEYMDVEGLKKLNKNKKLVKKLAKKYHAFLASEAVIKQIPRLLGPGLNKAGKFPTLVTHQESLESKVNETKATVKFQLKKVLCMGVAVGNLDMDEKQIFQNVQMSVNFLVSLLKKNWQNVRCLYLKSTMGKTQRVF

SEQ ID NO: 5518 - protein, 216 aa, Sequoia sempervirens
MSKLQSDVLREAITGLVGESKDKKRKFVETIELQIGLKNYDPQKDKRFSGSVKLPHIPRPKMKLCMLGDAQHVEEAEKIGLDYMDVEGLKKMNKNKKLVKKLAKKYHAFLASEAIIKQIPRLLGPGLNKAGKFPTLVSHQESLEGKVNETKATIKFQLKKVLCMGVAVGNCGMEEKQIFQNVQLSVNFLVSLLKKNWQNVRCLYLKSTMGKPSRIF

SEQ ID NO: 5519 - protein, 155 aa, Taxus baccata
MKLCMLGDAQHIEEAEKIGLDYMDVEGLKKMNKNKKLVKKLAKKYHAFLASEAIIKQIPRLLGPGLNKAGKFPTLVSHQESLEAKVNETKATIKFQLKKVLCMGVAVGNCGMDEKQIFQNVQLSVNFLVSLLKKNWQNVRCLYLKSTMGKPSRIF

SEQ ID NO: 5520 - protein, 220 aa, Amsonia hubrichtii
MSKLQSDAVKEAIAQIVTDSKGDNGEKKRKFTETVELQIGLKNYDPQKDKRFSGSVKLPHIPRPKMKICMLGDAQHVEEAEKIGLEYMDVEGLKKLNKNKKLVKKLAKKYHAFLASEAVIKQIPRLLGPGLNKAGKFPTLVTHQESLESKVNETKATVKFQLKKVLCMGVAVGNLDMEEKQIFQNVQMSVNFLVSLLKKNWQNVRCLYLKSTMGRPQRIF

SEQ ID NO: 5521 - protein, 218 aa, Vinca minor
MSKLQSDAVREAISQIVADCNKEDKKRKFTETVELQIGLKNYDPQKDKRFSGSVKLPHIPRPKMKVCMLGDAQHVGEAEKIGLEYMDVEGLKKLNKNKKLVKKLAKKYHAFLASEAVIKQIPRLLGPGLNKAGKFPTLVSHQESLESKVNEIKATVKFQLKKVLCMGVAVGNLSMEEKQIFQNVQMSVNFLVSLLKKNWQNVRCLYLKSTMGRPQRIF

SEQ ID NO: 5522 - protein, 217 aa, Valeriana officinalis
MSKLQSEALREAITQIAGDARGDKKRNFTETIELQIGLKNYDPQKDKRFSGSVKLPHIPRPKMKVCMLGDAQHVEEAEKIGLEYMDVEGLKKLNKNKKLVKKLAKKYHAFLASEAVIKQIPRLLGPGLNKAGKFPTLVTHQESLESKVNEIKATVKFQLKKVLCMGVAVGNCAMDDKQIFQNVQMSVNFLVSLLKKNWQNVRCLYLKSTMGKPQRIF

SEQ ID NO: 5523 - protein, 217 aa, Brassica juncea
MSKLQSEAVREAISSMITHCKETKPRKFTETIELQIGLKNYDPQKDKRFSGSVKLPHIPRPKMKICMLGDAQHVEEAEKIGLESMDVEALKKLNKNKKLVKKLAKKFHAFLASESVIKQIPRLLGPGLNKAGKFPTLVSHQESLESKVNETKATVKFQLKKVLCMGVAVGNLDMEEKQIFQNVQMSVNFLVSLLKKNWQNVRCLYLKSTMGPPNRVF

SEQ ID NO: 5524 - protein, 217 aa, Brassica juncea
MSKLQSEAVREAISAMITHCKETKPRKFTETIELQIGLKNYDPQKDKRFSGSVKLPHIPRPKMKICMLGDAQHVEEAEKIGLESMDVEALKKLNKNKKLVKKLAKKFHAFLASESVIKQIPRLLGPGLNKAGKFPTLVSHQESLESKVNETKATVKFQLKKVLCMGVAVGNLGMEEKQIFQNVQMSVNFLVSLLKKNWQNVRCLYLKSTMGPPNRVF

SEQ ID NO: 5525 - protein, 217 aa, Brassica oleracea
MSKLQSEAVKDAISTIITHCKETKPRKFTETIELQIGLKNYDPQKDKRFSGSVKLPHIPRPKMKICMLGDAQHVEEAEKIGLESMDVEALKKLNKNKKLVKKLAKKFHAFLASESVIKQIPRLLGPGLNKAGKFPTLVSHQESLESKVNETKATVKFQLKKVLCMGVAVGNLGMEEKQIFQNVQMSVNFLVSLLKKNWQNVRCLYLKSTMSPPTRVF

SEQ ID NO: 5526 - protein, 217 aa, Unknown
  Sequence found in Organisms: Brassica napus, Brassica rapa
MSKLQSEAVREAISSMITHCKETKPRKFTETIELQIGLKNYDPQKDKRFSGSVKLPHIPRPKMKICMLGDAQHVEEAEKIGLDSMDVEALKKLNKNKKLVKKLAKKFHAFLASESVIKQIPRLLGPGLNKAGKFPTLVSHQESLEAKVNETKATVKFQLKKVLCMGVAVGNLGMEEKQIFQNVQMSVNFLVSLLKKNWQNVRCLYLKSTMGPPNRVF

SEQ ID NO: 5527 - protein, 136 aa, Cucurbita pepo
MSKLQSEALREAISSIFTDSNEKKRKFTETIELQIGLKNYDPQKDKRFSGSVKLPHIPRPKMKICMLGDALHVEEAEKIGLDYMDVEGLKKLNKNKKLVKKLAKNTTPFWLLKLLSSRSLVFWALVSTKQENSQHW

SEQ ID NO: 5528 - protein, 183 aa, Secale cereale
MSKLQSEALREAITNIINDCREKNRKFVETIELQIGLKNYDPQKDKRFSGSVKLPHIPRPKMRVCMLGDAQHVEEAGKMGLDCMDVESLKKMNKNKKLVKKLAKKYHAFLASEAIIKQIPRLLGPGLNKAGKFPTLVSHQESLESKVNETKATVKFQLKRFFAWVLPLATWVWRRSRSSRTCR

SEQ ID NO: 5529 - protein, 150 aa, Picea glauca
MSKLQSDVLREGITQVMGESKDKKRKFTETIELQIGLKNYDPQKDKRFSGSVKLPHIPRPKMKVCMLGDAQHVEEAEKLGLDYMDVEGLKKMNKNKKLVKKLAKKYHAFLASEAIIKQIPRLLGPGLNKAGKFPTLVSHQESLEGKVNET

SEQ ID NO: 5530 - protein, 228 aa, Curcuma longa
ASGLKEEDVDVKNEQVAESFTQGSNLSDVGDCLEKKRNFTETIELQIGLKNYDPQKDQRFSGSVKLPHIPRPKMKVCMLGDAQHIEEAEKIGLDYMDVESLKKMNKNKKLVKKLAKKYHAFLASEAIIKQIPRLLGPGLNKAGKFPTLVTHQETLESKVNETKAMVKFQLKKVLCMGVAVGNVAMEEKHIFQNVQMSVNLLVSLLKKNWQNVRCLYLKSTMGKPSRIF

SEQ ID NO: 5531 - protein, 216 aa, Aquilegia formosa
MSKLQSDVLREGISQIVNESKQKERKFVGTIELQIGLKNYDPQKDKRFSGSVKLPHIPRPKMKVCMLGDAQHVEEAEKIGLEYMDVEGLKKLNKNKKLVKKLAKKFHAFLASEAVIKQIPRLLGPGLNKAGKFPTLVTHQESLESKVNETKAMVKFQLKKVLCMGVAVGNLGMDEKQIFQNVQLSVNFLVSLLKKNWQNVRCLYLKSTMGKPFRIF

SEQ ID NO: 5532 - protein, 216 aa, Cucurbita pepo
MSKLQSEALREAISSIFTDSNEKKRNFTETIELQIGLKNYDPQKDKRFSGSVKLPHIPRPKMKLCMLGDALHVEEAEKIGLDYMDVEGLKKLNKNKKLVKKLAKKYHAFLASEAVIKQIPRLLGPGLNKAGKFPTLVTHQESLESKVNETKAMVKFQLKKVLCMGVAVGNVAMEEKQVFQNVQMSVNFLVSLLKKNWQNVRCLYLKSTMGKSYRVF

SEQ ID NO: 5533 - protein, 216 aa, Cucurbita pepo
MSKLQSEALREAISSIFGDSSEKKRNFTETIELQIGLKNYDPQKDKRFSGSVKLPHIPRPKMKICMLGDALHVEEAEKIGLDYMDVEGLKKLNKNKKLVKKLAKKYHAFLASEAVIKQIPRLLGPGLNKAGKFPTLVTHQESLESKVNETKAMVKFQLKKVLCMGVAVGNVAMEEKQVFQNVQMSVNFLVSLLKKNWQNVRCLYLKSTMGKAYRVF

SEQ ID NO: 5534 - protein, 216 aa, Euonymus alatus
MSKLQSDALREAISTIVKDCTEKKRNFVQTIELQIGLKNYDPQKDKRFSGSVKLPHIPRPKMKVCMLGDAQHVEQAEKIGLDYMDVEALKKLNKNKKLVKKLAKKYHAFLASESVIKQIPRLLGPGLNKAGKFPTLVSHQESLESKVNETKATVKFQLKKVLCMGVAVGNVSMEEKQIFQNVQMSVNFLVSLLKKNWQNVKCLYLKSTMGSPNRIF

SEQ ID NO: 5535 - protein, 216 aa, Fagopyrum esculentum
MSKLQSEALREAISGITNDSKEKARKFTETIELQIGLKNYDPQKDKRFSGSVKLPHIPRPKMKVCMLGDAQHVEESEKMGLDYMDVEALKKLNKNKKLVKKLAKKYHAFLASESVIKQIPRLLGPGLNKAGKFPTLVSHQESLESKVNEIKATVKFQLKKVLCMGVAVGNCGMEEKQIFQNVQMSINFLVSLLKKNWQNVRCLYLKSTMGKPYRIF

SEQ ID NO: 5536 - protein, 216 aa, Humulus lupulus
MSKLSSDAVREGIAQIVINSKEKNRKFTETIELQIGLKNYDPQKDKRFSGSVKLPHIPRPKMKICMLGDAQHVEEAEKIGLDYMDVEGLKKLNKNKKLVKKLAKKFHAFLASEAVIKQIPRLLGPGLNKAGKFPTLVTHQESLESKVNETKAMVKFQLKKVLCMGVAVGNLSMEEKQIFQNVQMSVNFLVSLLKKNWQNVRCLYLKSTMGSAIRIF

SEQ ID NO: 5537 - protein, 216 aa, Olea europaea
MSKLQSEALREAISVITTDTKEKNRNFVETIELQIGLKNYDPQKDKRFSGSVKLPHIPRPKMKICMLGDAQHVEEAEKIGLESMDVEALKKLNKNKKLVKKLAKRYHAFLASEAVIKQIPRLLGPGLNKAGKFPTLVSHQESLESKVNETKATVKFQLKKVLCMGVAVGNCAMEEKQIFQNVQMSVNFLVSLLKKNWQNVRCLYLKSTMGKPQRIF

SEQ ID NO: 5538 - protein, 216 aa, Plantago ovata
MSKLQSEALREAITAITADAKEKNRKFTETIELQIGLKNYDPQKDKRFSGSVKLPHIPRPKMKICMLGDAQHVEEAEKIGMESMDVEALKKLNKNKKLVKKLAKKYHAFLASEAVIKQIPRLLGPGLNKAGKFPTLVSHQESLESKVNETKATVKFQLKKVLCMGVAVGNCAMEDKQIFQNVQMSVNFLVSLLKKNWQNVRCLYLKTTMGKPQRIF

SEQ ID NO: 5539 - protein, 216 aa, Papaver somniferum
MSKLAADVVKEAIAQIVAESKEKNRNFTETIELQIGLKNYDPQKDKRFSGSVRLPHIPRPKMKVCMLGDAQHVEEAQSIGLDHMDVEGLKRLNKNKKLVKKLAKKYHAFLASEAVIKQIPRLLGPGLNKAGKFPTLVTHQESLESKVNETKAMVKFQLKKVLCMGVAVGNLGMEERQIFQNVQLSVNFLVSLLKKNWQNVRCLYLKSTMGKVNRVF

SEQ ID NO: 5540 - protein, 216 aa, Pteridium aquilinum
MSKLQSDVLREAITQILADSKEKNRKFVETVELQIGLKNYDPQKDKRFSGSVKLAHIPRPKMKVCMLGDAQHVEEAEKIGLDCMDVDALKKMNKNKKLVKKLAKKYHAFLASEAVIKQIPRLLGPGLNKAGKFPTLVQHQESLEGKVNETKATVKFQLKKVLCMGVAVGNLEMEEKQLFQNVQLSVNFLVSLLKKNWQNVRVLYLKTTMGKPVRIF

SEQ ID NO: 5541 - protein, 216 aa, Unknown
  Sequence found in Organisms: Secale cereale, Triticum aestivum
MSKLQSDALREAITNIINDCREKNRKFVETIELQIGLKNYDPQKDKRFSGSVKLPHIPRPKMRVCMLGDAQHVEEAGKMGLDCMDVESLKKMNKNKKLVKKLAKKYHAFLASEAIIKQIPRLLGPGLNKAGKFPTLVSHQESLESKVNETKATVKFQLKKVLCMGVAVGHLGMEEKQIFQNVQMSVNFLVSLLKKNWQNVRCLYLKSTMGKVYRLF

SEQ ID NO: 5542 - protein, 215 aa, Secale cereale
SKLQSEALREAITNIINDCREKNRKFVETIELQIGLKNYDPQKDKRFSGSVKLPHIPRPKMRVCMLGDAQHVEEAGKMGLDCMDVESLKKMNKNKKLVKKLAKKYHAFLASEAIIKQIPRLLGPGLNKAGKFPTLVSHQESLESKVNETKATVKFQLKKVLCMGVAVGHLGMEEKQIFQNVQMSVNFLVSLLKKNWQNVRCLYLKSTMGKVYRLF

SEQ ID NO: 5543 - protein, 216 aa, Tripterygium wilfordii
MSKLQSDALREAISTIVKESAEKKRNFVQTIELQIGLKNYDPQKDKRFSGSVKLPHIPRPKMKVCMLGDAQHVEEAEKMGLDYMDVEALKKLNKNKKLVKKLAKKYHAFLASESVIKQIPRLLGPGLNKAGKFPTLVSHQESLESKVNETKAMVKFQLKKVLCMGVAVGNVSMEEKQIFQNVQMSVNFLVSLLKKNWQNVKCLYLKSTMGSPNRIF

SEQ ID NO: 5544 - protein, 216 aa, Citrullus lanatus
MSKLQSDALREAISSIFADSSEKKRNFTETIELQIGLKNYDPQKDKRFSGSVKLPHIPRPKMKICMLGDASHVEEAEKIGLDYMDVEGLKKLNKNKKLVKKLAKKYHAFLASEAIIKQIPRLLGPGLNKAGKFPTLVTHQESLESKVNETKAMVKFQLKKVLCMGVAVGNVAMEEKQVFQNVQMSVNFLVSLLKKNWQNVRCLYLKSTMGKAYRVF

SEQ ID NO: 5545 - protein, 216 aa, Antirrhinum majus
MSKLQSEALREAISVISGDVKEKKRNFTETIELQIGLKNYDPQKDKRFSGSVKLPHIPRPKMKICMLGDAQHVEEAAKIGLESMDVEALKKLNKNKKLVKKLAKKYHAFLASEAVIKQIPRLLGPGLNKAGKFPTLVSHQESLESKVNETKATVKFQLKKVLCMGVAVGNCGMEEKQIFQNVQMSVNFLVSLLKKNWQNVRCLYLKSTMGKPQRIF

SEQ ID NO: 5546 - protein, 216 aa, Unknown
  Sequence found in Organisms: Hordeum vulgare, Pseudoroegneria spicata
MSKLQSDALREAITNITNDCREKNRKFVETIELQIGLKNYDPQKDKRFSGSVKLPHIPRPKMRVCMLGDAQHVEEAGKMGLDCMDVESLKKMNKNKKLVKKLAKKYHAFLASEAIIKQIPRLLGPGLNKAGKFPTLVSHQESLESKVNETKATVKFQLKKVLCMGVAVGHLGMEEKQIFQNVQMSVNFLVSLLKKNWQNVRCLYLKSTMGKVYRLF

SEQ ID NO: 5547 - protein, 216 aa, Cleome spinosa
MSKLQSDALREAISIIKGKCEEKKRNFVETIELQIGLKNYDPQKDKRFSGSVKLPHIPRPKMKVCMLGDAQHVEEAEKMGLDYMDVEALKKLNKNKKLVKKLAKKYHAFLASESVIKQIPRLLGPGLNKAGKFPTLVSHQESLESKVNETKATVKFQLKKVLCMGVAVGNLAMEEKQIFQNVQMSVNFLVSLLKKNWQNVRCLYLKSTMGPPQRIF

SEQ ID NO: 5548 - protein, 216 aa, Cleome spinosa
MSKLQSEALREAISTIKAKCEEKKRNFVETIELQIGLKNYDPQKDKRFSGSVKLPHIPRPKMKICMLGDAQHVEEAEKMGLDYMDVEALKKLNKNKKLVKKLAKKYHAFLASESVIKQIPRLLGPGLNKAGKFPTLVSHQESLESKVNETKATVKFQLKKVLCMGVAVGNLSMEEKQIFQNVQMSVNFLVSLLKKNWQNVRCLYLKSTMGPVQRIF

SEQ ID NO: 5549 - protein, 216 aa, Solanum melongena
MSKLQSDALREAISVIKNDANEKKRKFTETIELQIGLKNYDPQKDKRFSGSVKLPHIPRPKMKICMLGDAQHVEEAEKIGLEYMDVESLKKLNKNKKLVKKLAKKYHAFLASEAVIKQIPRLLGPGLNKAGKFPTLVSHQESLESKVNETKATIKFQLKKVLCMGVAVGNMDMEEKQIFQNVQMSVNFLVSLLKKNWQNVRCLYLKSTMGKTQRIF

SEQ ID NO: 5550 - protein, 216 aa, Actinidia deliciosa
MSKLQSDAVREAISQIAGDSKEKKRKFVETIELQIGLKNYDPQKDKRFSGSVKLPHIPRPKMKVCMLGDAQHVEEAEKIGMDYMDVEGLKKLNKNKKLVKKLAKKYHAFLASEAVIKQIPRLLGPGLNKAGKFPTLVTHQESLESKVNETKATVKFQLKKVLCMGVAVGNCGMEDKQIFQNVQMSVNFLVSLLKKNWQNVRCLYLKSTMGRPVRIF

SEQ ID NO: 5551 - protein, 216 aa, Lotus japonicus
MSKLQNDAVREAISGIMTDSKEKNRKFVETIELQIGLKNYDPQKDKRFSGSVKLPHIPRPKMKICMLGDAQHVEEAEKIGLDWMDVEALKKLNKNKKLVKKLAKKYHAFLASEAVIKQIPRLLGPGLNKAGKFPTLVTHQESLEAKVNETKAMVKFQLKKVLCMGVAVGNVSMEEKQIFQNVQLSVNFLVSLLKKNWQNVRCLYLKSTMGKSYRVF

SEQ ID NO: 5552 - protein, 216 aa, Marchantia polymorpha
MSKLQSDVLREAITQVVTEAKEKNRKFTETVELQIGLKNYDPQKDKRFSGSVKLPHVPRPKMKVCMLGDAQHVEEAEKMGLDYMDIESLKKMNKNKKLVKKLAKKYHAFLASEAVIKQIPRLLGPGLNKAGKFPALVSHQESLEAKVNETKAMVKFQLKKVLCMGVAVGNCEMEEKQIFQNTQLSVNFLVSLLKKNWQNVRVLYLKTSMGKPVRIY

SEQ ID NO: 5553 - protein, 216 aa, Capsicum annuum
MSKLQSEALREAISVIKNDANEKKRKFTETIELQIGLKNYDPQKDKRFSGSVKLPHIPRPKMKICMLGDAQHVGEAEKIGLEYMDVEGLKKLNKNKKLVKKLAKKYHAFLASEAVIKQIPRLLGPGLNKAGKFPTLVSHQESLESKVNETKATIKFQLKKVLCMGVAVGNMDMEEKQIFQNVQMSVNFLVSLLKKNWQNVRCLYLKSTMGKTQRIF

SEQ ID NO: 5554 - protein, 216 aa, Unknown
  Sequence found in Organisms: Glycine max, Cajanus cajan
MSKLQSDALREAISGIMADSKEKNRKFVETIELQIGLKNYDPQKDKRFSGSVKLPHIPRPKMKICMLGDAQHVEEAEKIGLDWMDVEALKKLNKNKKLVKKLAKKYHAFLASEAVIKQIPRLLGPGLNKAGKFPTLVTHQETLESKVNESKAMVKFQLKKVLCMGVAVGNVSMEEKQIFQNVQLSVNFLVSLLKKNWQNVRCLYLKSTMGKSYRVF

SEQ ID NO: 5555 - protein, 216 aa, Salvia sclarea
MSKLQSEALREAITVIVAEANEKKRNFTQTVELQIGLKNYDPQKDKRFSGSVRLPHIPRPKMKLCMLGDAQHVEEAEKIGLESMDVEALKKLNKNKKLVKKLAKRYHAFLASEAVIKQIPRLLGPGLNKAGKFPTLVTHQESLEAKVNETKATVKFQLKKVLCMGVAVGNLDMEEKQIFQNVQMSVNFLVSLLKKNWQNVRCLYLKSTMGRVQRIF

SEQ ID NO: 5556 - protein, 216 aa, Glycine max
MSKLQSDALREAISGIMADSKEKNRKFVETIELQIGLKNYDPQKDKRFSGSVKLPHIPRPKMKICMLGDAQHVEEAEKIGLDWMDVEALKKLNKNKKLVKKLAKKYHAFLASEAVIKQIPRLLGPGLNKAGKFPTLVTHQETLESKVNESKAMVKFQLKKVLCMGVAVGNVSMEEKQIFQNVQLSVNFLVSLLKKNWQNVRCLYLKSTMGKCYRVF

SEQ ID NO: 5557 - protein, 216 aa, Nicotiana tabacum
MSKLQSDALREAITVIKSASNEKKRKFTETIELQIGLKNYDPQKDKRFSGSVKLPHIPRPKMKICMLGDAQHVEEAEKIGLEYMDVEGLKKLNKNKKLVKKLAKKYHAFLASEAVIKQIPRLLGPGLNKAGKFPSLVTHQESLESKVNETKATIKFQLKKVLCMGVAVGNMDMEEKQIFQNVQMSVNFLVSLLKKNWQNVRCLYLKSTMGKTQRVF

SEQ ID NO: 5558 - protein, 216 aa, Nicotiana tabacum
MSKLQSDALREAISVIKNDCAEKKRKFTETIELQIGLKNYDPQKDKRFSGSVKLPHIPRPKMKICMLGDAQHVEEAEKIGLEYMDVESLKKLNKNKKLVKKLAKKYHAFLASESVIKQIPRLLGPGLNKAGKFPSLVSHQESLESKVNETKATIKFQLKKVLCMGVAVGNLDMEEKQIFQNVQMSVNFLVSLLKKNWQNVRCLYLKSTMGKPQRVF

SEQ ID NO: 5559 - protein, 216 aa, Nicotiana tabacum
MSKLQSEALREAISVIKNDCNEKKRKFTETIELQIGLKNYDPQKDKRFSGSVKLPHIPRPKMKICMLGDAQHVEEAEKIGLEYMDVESLKKLNKNKKLVKKLAKKYHAFLASESVIKQIPRLLGPGLNKAGKFPSLVSHQESLESKVNETKATIKFQLKKVLCMGVAVGNLDMEEKQIFQNVQMSVNFLVSLLKKNWQNVRCLYLKSTMGKTQRVF

SEQ ID NO: 5560 - protein, 216 aa, Aquilegia formosa
MSKLQSDVLREGITQITNGAKEKKRNFTETVELQIGLKNYDPQKDKRFSGSVKLPHIPRPKMKICMLGDAQHVEEAEKIGLEYMDVEGLKKLNKNKKLVKKLAKKYHAFLASEAVIKQIPRLLGPGLNKAGKFPTLVTHQESLESKVNESKAMVKFQLKKVLCMGVAVGNLGMDEKQIFQNVQLSVNFLVSLLKKNWQNVRCLYLKSSMGKPVRIF

SEQ ID NO: 5561 - protein, 216 aa, Cicer arietinum
MSKLQSEALREAISGITADSKEKNRKFVETIELQIGLKNYDPQKDKRFSGSVKLPHIPRPKMKICMLGDAQHVEEAEKIGLDWMDVEALKKLNKNKKLVKKLAKKYHAFLASEAVIKQIPRLLGPGLNKAGKFPALVSHQESLESKVNETKAMVKFQLKKVLCMGVAVGNISMDEKQIFQNVQLSVNFLVSLLKKNWQNVRCLYLKSSMGKSYRVF

SEQ ID NO: 5562 - protein, 216 aa, Unknown
  Sequence found in Organisms: Cirsium arvense, Cynara scolymus
MSKLGSEAVREAITQITTEAKEKNRKFTETIELQIGLKNYDPQKDKRFSGTVKLPHIPRPKLKVCMLGDAQHVEEAQKIGLEYMDVEGLKKLNKNKKLVKKLAKKHQAFLASESVIKQIPRLLGPGLNKAGKFPTLVTHQESLESKVNEIKATVKFQLKKVLCMGVAVGNCSMEEKQIFQNVQMSVNFLVSLLKKNWQNVRCLYLKTTMGKPVRVF

SEQ ID NO: 5563 - protein, 216 aa, Cucurbita pepo
MSKLQSEALREAISSIFGDSTEKKRNFTETIELQIGLKNYDPQKDKRFSGSVKLPHIPRPKMKLCMLGDALHVEEAEKIGMDYMDVEGLKKLNKNKKLVKKLAKKYHAFLASEAVIKQIPRLLGPGLNKAGKFPTLVTHQESLESKVNETKAMVKFQLKKVLCMGVAVGNVAMEEKQVFQNVQMSVNFLVSLLKKNWQNVRCLYLKSTMGKAYRVF

SEQ ID NO: 5564 - protein, 216 aa, Euonymus alatus
MSKLQSDALREAITTIVKESTEKKKNFVQTIELQIGLKNYDPQKDKRFSGSVKLPHIPRPKMKVCMLGDAQHVEQAEKIGLDYMDVEALKKLNKNKKLVKKLAKKYHAFLASESVIKQIPRLLGPGLNKAGKFPTLVSHQESLESKVNETKATVKFQLKKVLCMGVAVGNVSMEEKQIFQNVQMSVNFLVSLLKKNWQNVKCLYLKSTMGSPNRIF

SEQ ID NO: 5565 - protein, 216 aa, Fraxinus spp
MSKLQSEALREAISVITTDVKEKNRNFVETIELQIGLKNYDPQKDKRFSGSVKLPHIPRPKMKICMLGDAQHVEEAEKIGMESMDVEALKKLNKNKKLVKKLAKRYHAFLASEAVIKQIPRLLGPGLNKAGKFPTLVSHQESLESKVNETKATVKFQLKKVLCMGVAVGNCGMEEKQIFQNVQMSVNFLVSLLKKNWQNVRCLYLKSTMGKPQRIF

SEQ ID NO: 5566 - protein, 216 aa, Carpinus betulus
MSKLQSETLREVISQVLNAAKEKNRKFTETVELQIGLKNYDPQKDKRFSGSVKLPHIPRPKMKVCMLGDAQHVEEAEKIGLEYMDVEALKKLNKNKKLVKKLAKKYHAFLASESVIKQIPRLLGPGLNKAGKFPTLVTHQETLESKVIEVKAMVKFQLKKVLCMGVAVGNCSMEEKQLFQNVQMSINFLVSLLKKNWQNVRCLHLKSTMGSAIRLY

SEQ ID NO: 5567 - protein, 216 aa, Platanus occidentalis
MSKLQSDVLREAIGQIMGAAKEKNRKFTETIELQIGLKNYDPQKDKRFSGSVKLPHIPRPKMKVCMLGDAQHVEEAERMGLESMDVEALKKMNKNKKLVKKLAKKYHAFLASEAIIKQIPRLLGPGLNKAGKFPTLVSHQESLESKVNETKAMVKFQLKKVLCMGVAVGNCDMDEKQVFQNVQLSVNFLVSLLKKNWQNVRCLNLKTTMGKPYRIF

SEQ ID NO: 5568 - protein, 215 aa, Eutrema parvulum
KLQSEALREAISAIVTHCKETKPRKFTETIELQIGLKNYDPQKDKRFSGSVKLPHIPRPKMKICMLGDAQHVEEAEKIGLDSMDVEALKKLNKNKKLVKKLAKKFQAFLASESVIKQIPRLLGPGLNKAGKFPTLVSHQESLESKVNETKATVKFQLKKVLCMGVAVGNLDMEEKQIFQNVQMSVNFLVSLLKKNWQNVRCLYLKSTMGPPTRVF

SEQ ID NO: 5569 - protein, 216 aa, Citrullus lanatus
MSKLQSDALREAISSIFTDSNEKKRKFTETIELQIGLKNYDPQKDKRFSGSVKLPHIPRPKMKICMLGDASHVEEAEKIGLDYMDVEGLKKLNKNKKLVKKLAKKYHAFLASEAIIKQIPRLLGPGLNKAGKFPTLVTHQETLESKVNETKAMVKFQLKKVLCMGVAVGNVAMDEKQVFQNVQMSVNFLVSLLKKNWQNVRCLYLKSTMGKSYRVF

SEQ ID NO: 5570 - protein, 217 aa, Arabidopsis thaliana
MSKLQSEAVREAISSIITHCKETKPRNFTETIELQIGLKNYDPQKDKRFSGSVKLPHVPRPKMKICMLGDAQHVEEAEKIGLESMDVEALKKLNKNKKLVKKLAKKFHAFLASESVIKQIPRLLGPGLNKAGKFPTLVSHQESLESKVNETKATVKFQLKKVLCMGVAVGNLSMEEKQIFQNVQMSVNFLVSLLKKNWQNVRCLYLKSTMGPPNRVF

SEQ ID NO: 5571 - protein, 217 aa, Unknown
  Sequence found in Organisms: Brassica napus, Brassica juncea, Brassica oleracea, Brassica rapa
MSKLQSEAVREAISSMITHCKETKPRKFTETIELQIGLKNYDPQKDKRFSGSVKLPHIPRPKMKICMLGDAQHVEEAEKIGLESMDVEALKKLNKNKKLVKKLAKKFHAFLASESVIKQIPRLLGPGLNKAGKFPTLVSHQESLEAKVNETKATVKFQLKKVLCMGVAVGNLDMEEKQIFQNVQMSVNFLVSLLKKNWQNVRCLYLKSTMGPPNRVF

SEQ ID NO: 5572 - protein, 216 aa, Unknown
  Sequence found in Organisms: Phaseolus coccineus, Vigna unguiculata
MSKLQSDALREAITGIMADSKEKNRKFVETIELQIGLKNYDPQKDKRFSGSVKLPHIPRPKMKICMLGDAQHVEEAEKIGLDWMDVEALKKLNKNKKLVKKLAKKYHAFLASEAVIKQIPRLLGPGLNKAGKFPTLVTHQETLESKVNESKAMVKFQLKKVLCMGVAVGNVSMEEKQIFQNVQLSVNFLVSLLKKNWQNVRCLYLKSTMGKSYRVF

SEQ ID NO: 5573 - protein, 217 aa, Brassica napus
MSKLQSEAVKEAISTIITHCKETKPRKFTETIELQIGLKNYDPQKDKRFSGSVKLPHIPRPKMKICMLGDAQHVEEAEKIGLESMDVEALKKLNKNKKLVKKLAKKFHAFLASESVIKQIPRLLGPGLNKAGKFPTLVSHQESLESKVNETKATVKFQLKKVLCMGVAVGNLGMEEKQIFQNVQMSVNFLVSLLKKNWQNVRCLYLKSTMSPPTRVF

SEQ ID NO: 5574 - protein, 216 aa, Cleome gynandra
MSKLQSEALREAISTIKGKCEEKKRNFVETIELQIGLKNYDPQKDKRFSGSVKLPHIPRPKMKICMLGDAQHVEEAEKMGLDYMDVEALKKLNKNKKLVKKLAKKYHAFLASESVIKQIPRLLGPGLNKAGKFPTLVSHQESLESKVNETKATVKFQLKKVLCMGVAVGNIGMEEKQIFQNVQMSVNFLVSLLKKNWQNVRCLYLKSTMGPPQRIF

SEQ ID NO: 5575 - protein, 210 aa, Festuca arundinacea
MSKLSSDAVKEAIALIVGEAREKKRKFTETVELQIGLKNYDPQKDKRFSGSVKLPHIPRPKMRVCMLGDAQHVDQAEKLGLDSMDVESLKKMNKNKKLVKKLAKKYHAFLASEAIIKQIPRLLGPGLNKAGKFPTLVSHSESLEAKVNETKATVKFQLKKVLCMGVAVGNLSMDEKQIQQNLQMSVNFLVSLLKKNWQNVRCLYVKSTMG

SEQ ID NO: 5576 - protein, 216 aa, Ipomoea batatas
MSKLQSDAVREAISQLMGDSKEKNRKFTETIELQIGLKNYDPQKDKRFSGSVKLPHIPRPKMKVCMLGDAQHVEEAEKFGMEYMDVEGLKKLNKNKKLVKKLAKKYHAFLASEAVIKQIPRLLGPGLNKAGKFPTLVTHQESLETKVNETKATVKFQLKKVLCMGVAVGNVAMEEKQIFQNVQMSVNFLVSLLKKNWQNVRCLYLKTTMGRPIRIF

SEQ ID NO: 5577 - protein, 216 aa, Actinidia deliciosa
MSKLQSDAVREAISQIAGDAKEKKRKFVETIELQIGLKNYDPQKDKRFSGSVKLPHIPRPKMKVCMLGDAQHVEEAEKIGMDYMDVEGLKKLNKNKKLVKKLAKKYHAFLASEAVIKQIPRLLGPGLNKAGKFPTLVTHQESLESKVNETKATVKFQLKKVLCMGVAVGNCGMEDKQIFQNVQMSVNFLVSLLKKNWQNVRCLSLRSTMGRPARIF

SEQ ID NO: 5578 - protein, 216 aa, Tropaeolum majus
MSKLQSEALREAISTIMTASKEKQRNFTETIELQIGLKNYDPQKDKRFSGSVKLPHIPRPKMKACMLGDAQHVEEATKIGLDYMDVEALKKLNKNKKLVKKLAKKYHAFLASESVIKQIPRLLGPGLNKAGKFPTLVSHQESLEAKVNEIKATVKFQLKKVLCMGVAVGNCGMEEKQIFQNVQMSVNFLVSLLKKNWQNVRCLYLKSTMGPSNRVF

SEQ ID NO: 5579 - protein, 216 aa, Avena sativa
MSKLQSDSLREAITGITSDCREKNRKFSETIELQIGLKNYDPQKDKRFSGSVKLPHIPRPKMRVCMLGDAQHVEEAGKMNLDYMDVESLKKMNKNKKLVKKLAKKYHAFLASEAIIKQIPRLLGPGLNKAGKFPTLVSHQESLEAKVNETKATVKFQLKKVLCMGVAVGHMGMDEKQIFQNVQMSVNFLVSLLKKNWQNVRCLYLKSTMGKPHRLF

SEQ ID NO: 5580 - protein, 216 aa, Cajanus cajan
MSKLQSDALREAISGIMADSKEKNRKFVETIELQIGLKNYDPQKDKRFSGSVKLPHIPRPKMKICMLGDAQHVEEAEKIGLDYMDVEALKKLNKNKKLVKKLAKKYHAFLASEAVIKQIPRLLGPGLNKAGKFPTLVTHQETLESKVNESKAMIKFQLKKVLCMGVAVGNVSMEEKQIFQNVQLSVNFLVSLLKKNWQNVRCLYLKSSMGKSYRVF

SEQ ID NO: 5581 - protein, 217 aa, Raphanus sativus
MSKLQSEAVREAISAMITHCKETKPRKFTETIELQIGLKNYDPQKDKRFSGSVKLPHIPRPKMKICMLGDAQHVEEAEKIGLESMDVEALKKLNKNKKLVKKLAKKFHAFLASESVIKQIPRLLGPGLNKAGKFPTLVSHQESLEAKVNETKATVKFQLKKVLCMGVAVGNLDMEEKQIFQNVQMSVNFLVSLLKKNWQNVRCLYLKSTMGPPNRVF

SEQ ID NO: 5582 - protein, 216 aa, Raphanus sativus
MSKLQSEALREAITTIKGKSEEKKRNFTETVELQIGLKNYDPQKDKRFSGSVKLPHIPRPKMKVCMLGDAQHVEEAEKMGLDSMDVEALKKLNKNKKLVKKLAKKYHAFLASESVIKQIPRLLGPGLNKAGKFPTLVSHQESLEGKVNETKATVKFQLKKVLCMGVAVGNLSMEEKQLFQNVQMSINFLVSLLKKNWQNVRCLYLKSTMGPPQRIF

SEQ ID NO: 5583 - protein, 216 aa, Taxus baccata
MSKLQSDVLREAITGVVTESKEKPKKFVETIELQIGLKNYDPQKDKRFSGSVKLPHIPRPKMKLCMLGDAQHVEEAVKIGLDYMDVEGLKKMNKNKKLVKKLAKKYHAFLASEAIIKQIPRLLGPGLNKAGKFPTLVSHQESLEAKMNETKATIKFQLKKVLCMGVAVGNCGMEDKQIFQNVQLSVNFLVSLLKKNWQNVRCLYLKSTMGKPTRIF

SEQ ID NO: 5584 - protein, 216 aa, Nicotiana tabacum
MSKLQSDALREAISVIKNDCNEKKRKFTETIELQIGLKNYDPQKDKRFSGSVKLPHIPRPKMKICMLGDAQHVEEAEKIGLEYMDVESLKKLNKNKKLVKKLAKKYHAFLASESVIKQIPRLLGPGLNKAGKFPSLVSHQESLESKVNETKATIKFQLKKVLCMGVAVGNLDMEEKQIFQNVQMSVNFLVSLLKKNWQNVRCLYLKSTMGKTQRVF

SEQ ID NO: 5585 - protein, 216 aa, Nicotiana tabacum
MSKLQSDALREAISVIKNDCAEKKRKFTETIELQIGLKNYDPQKDKRFSGSVKLPHIPRPKMKICMLGDAQHVEEAEKIGLEYMDVESLKKLNKNKKLVKKLAKKYHAFLASESVIKQIPRLLGPGLNKAGKFPSLVSHQESLESKVNETKATIKFQLKKVLCMGVAVGNLDMEEKQIFQNVQMSVNFLVSLLKKNWQNVRCLYLKGTMGKPQRVF

SEQ ID NO: 5586 - protein, 155 aa, Lippia dulcis
MKICMLGDAQHVEEAEKIGLESMDVEALKKLNKNKKLVKKLAKRYHAFLASEAVIKQIPRLLGPGLNKAGKFPTLVTHQESLESKVNETKATIKFQLKKVLCMGVAVGNLDMEEKQIFQNVQMSVNFLVSLLKKNWQNVRCLFLKSTMGKPQRIF

SEQ ID NO: 5587 - protein, 162 aa, Secale cereale
MSKLQSEALREAITNIINDCREKNRKFVETIELQIGLKNYDPQKDKRFSGSVKLPHIPRPKMRVCMLGDAQHVEEAGKMGLDCMDVESLKKMNKNKKLVKKLAKKYHAFLASEAIIKQIPRLLGPGLNKAGKFPTLVSHQESLESKVNETKATVKFQLKKVL

SEQ ID NO: 5588 - protein, 221 aa, Cannabis sativa
CNCYDNSKLQSEVLREAIATIMNESREKNRNFTETIELQIGLKNYDPQKDKRFSGSVKLPHIPRPKMKVCMLGDAQHVEEAVKINLDYMDVEGLKKLNKNKKLVKKLAKKYHAFLASEAVIKQIPRLLGPGLNKAGKFPTLVTHQESLESKVNETKAMVKFQLKKVLCMGVAVGNLSMEEKQVFQNVQMSVNFLVSLLKKNWQNVRCLFLKTTMGKPQRVF

SEQ ID NO: 5589 - protein, 253 aa, Oryza sativa
MADYNRYGYGGYGSTPSAPPASSYGYTTTPSAPPASSSSSYGYGHGGGGYPSSTYPPPPPSSSQAYPMGMGGFLVFPPGTHPDVERAFRAVDRDGSGSIDERELQDALSSAYHRFSIRTVRLLLFLFNKPASHSPSRMGPAEFVSLWNCLGQWRGIFDRYDRDGSGKIEKDELREALRSLGYAVPPSVLELLIANYNNGVSSRGALDFDNFVECGMIVKGLTEKFKEKDTRYSGSATLSYDGFLSMVIPFIVP

SEQ ID NO: 5590 - protein, 218 aa, Vinca minor
MSKLQSDAVREAITQIVTDCNKEDKKRKFTETVELQIGLKNYDPQKDKRFSGSVKLPHIPRPKMKVCMLGDAQHVGEAEKIGLEYMDVEGLKKLNKNKKLVKKLAKKYHAFLASEAVIKQIPRLLGPGLNKAGKFPTLVSHQESLESKVNEIKATVKFQLKKVLCMGVAVGNLDMEEKQIFQNVQMSVNFLVSLLKKNWQNVRCLYLKSTMGRPQRIF

SEQ ID NO: 5591 - protein, 217 aa, Arabidopsis lyrata
CSKLQSEAVREAISSIITHCKETKPRNFTETIELQIGLKNYDPQKDKRFSGSVKLPHVPRPKMKICMLGDAQHVEEAEKIGLESMDVEALKKLNKNKKLVKKLAKKFHAFLASESVIKQIPRLLGPGLNKAGKFPTLVSHQESLESKVNETKATVKFQLKKVLCMGVAVGNLSMEEKQIFQNVQMSVNFLVSLLKKNWQNVRCLYLKSTMGPPNRVF

SEQ ID NO: 5592 - protein, 217 aa, Unknown
  Sequence found in Organisms: Brassica napus, Brassica rapa
MSKLQSEAVKEAISTIITHCKETKPRKFTETIELQIGLKNYDPQKDKRFSGSVKLPHIPRPKMKICMLGDAQHVEEAEKIGLESMDVEALKKLNKNKKLVKKLAKKFHAFLASESVIKQIPRLLGPGLNKAGKFPTLVSHQESLEAKVNETKATVKFQLKKVLCMGVAVGNLGMEEKQIFQNVQMSVNFLVSLLKKNWQNVRCLYLKSTMSPPTRVF

SEQ ID NO: 5593 - protein, 217 aa, Raphanus sativus
MSKLQSEAVREAISSIITHCKETKPRKFTETIELQIGLKNYDPQKDKRFSGSVKLPHIPRPKMKICMLGDAQHVEEAEKIGLESMDVEALKKLNKNKKLVKKLAKKFHAFLASESVIKQIPRLLGPGLNKAGKFPTLVSHQESLESKVNETKATVKFQLKKVLCMGVAVGNLGMEEKQIFQNVQMSVNFLVSLLKKNWQNVRCLYLKSTMSPPTRVF

SEQ ID NO: 5594 - protein, 215 aa, Secale cereale
SKLQSDALREAITNIINDCREKNRKFVETIELQIGLKNYDPQKDKRFSGSVKLPHIPRPKMRVCMLGDAQHVEEAGKMGLDCMDVESLKKMNKNKKLVKKLAKKYHAFLASEAIIKQIPRLLGPGLNKAGKFPTLVSHQESLESKVNETKATVEVPVEEGSLHGCCRWPPGYGGEADLPERADERELPRLSVEEELAKVRCLYLKSTMGKVYRLF

SEQ ID NO: 5595 - protein, 183 aa, Cryptomeria japonica
MSKLQSDVLREAITGLVADSKEKKRKFVETIELQIGLKNYDPQKDKRFSGSVKLPHIPRPKMKLCMLGDAQHVEEAEKIGLDYMDVEGLKKMNKNKKLVKKLAKKYHAFLASEAIIKQIPRLLGPGLNKAGKFPTLVSHQESLEGKVNENKATIKFQLKKVLCMGVAVGNCGMEESKYFRMSS

SEQ ID NO: 5596 - protein, 199 aa, Salvia sclarea
MSKLQSEALREAITVIVKEANEKKRNFTQTVELQIGLKNYDPQKDKRFSGSVRLPHIPRPKMKLCMLGDAQHVEEAEKIGLESMDVEALKKLNKNKKLVKKLAKRYHAFLASEAVIKQIPRLLGPGLNKAGKFPTLVTHQESLEAKVNETKATIKFQLKKVLCMGVAVGNLDMEEKQIFQNVQMSVNFLVSLLKKIGKT

SEQ ID NO: 5597 - protein, 216 aa, Cannabis sativa
MSKLSSDAVREGIAQIVINSKEKNRKFTETIELQIGLKNYDPQKDKRFSGSVKLPHIPRPKMKICMLGDAQHVEEAVKIGLDYMDVEGLKKLNKNKKLVKKLAKKFHAFLASEAVIKQIPRLLGPGLNKAGKFPTLVTHQESLEAKVNETKAMVKFQLKKVLCMGVAVGNLSMEEKQIFQNVQMSVNFLVSLLKKNWQNVRCLYLKSTMGSAIRIF

SEQ ID NO: 5598 - protein, 216 aa, Cicer arietinum
MSKLQSDALREAISGITADSKEKNRKFVETIELQIGLKNYDPQKDKRFSGSVKLPHIPRPKMKICMLGDAQHVEEAEKIGLDWMDVEALKKLNKNKKLVKKLAKKYHAFLASEAVIKQIPRLLGPGLNKAGKFPALVSHQESLESKVNETKAMVKFQLKKVLCMGVAVGNVSMDEKQIFQNVQLSVNFLVSLLKKNWQNVRCLYLKSSMGKSYRVF

SEQ ID NO: 5599 - protein, 216 aa, Cicer arietinum
MSKLQSDALREAISGITADSKEKNRKFVETIELQIGLKNYDPQKDKRFSGSVKLPHIPRPKMKICMLGDAQHVEEAEKIGLDWMDVEALKKLNKNKKLVKKLAKKYHAFLASEAVIKQIPRLLGPGLNKAGKFPALVSHQESLESKVNETKAMVKFQLKKVLCMGVAVGNISMDEKQIFQNVQLSVNFLVSLLKKNWQNVRCLYLKSSMGKSYRVF

SEQ ID NO: 5600 - protein, 216 aa, Fagopyrum esculentum
MSKLSNEALREAVGSIKKDATEKQKKFTETIELQIGLKNYDPQKDKRFSGSVKLPHIPRPKMKVCMLGDAQHVEESEKMGLDSMDVEALKKLNKNKKLVKKLAKKYHAFLASEAVIKQIPRLLGPGLNKAGKFPTLVSHQESLESKVNEIKATVKFQLKKVLCMGVAVGNCGMEEKQIFQNVQMSVNFLVSLLKKNWQNVRCLYLKSTMGKPYRIF

SEQ ID NO: 5601 - protein, 216 aa, Amaranthus tuberculatus
MSKLQSEAVREAITGIKTDSAEKGRKFTETIELQIGLKNYDPQKDKRFSGSVKLPHIPRPKMKVCMLGDAQHVEEAERIGLEWMDVEALKKLNKNKKLVKKLAKKYHAFLASEAVIKQIPRLLGPGLNKAGKFPTLVTHQEPLENKVNEIKATVKFQLKKVLCMGVAVGNCSMEEKQVFQNVQMSVNFLVSLLKKNWQNVRCLYLKSTMGKPYRIF

SEQ ID NO: 5602 - protein, 216 aa, Cichorium intybus
MSKLASEAVREAITQITTDAKEKNRKFTETIELQIGLKNYDPQKDKRFSGTVKLPHIPRPKLKVCMLGDAQHVEEAQKIGLEYMDVEGLKKLNKNKKLVKKLAKKHQAFLASESVIKQIPRLLGPGLNKAGKFPTLVSHQESLESKVNETKATVKFQLKKVLCMGVAVGNCSMEEKQIFQNVQMSVNFLVSLLKKNWQNVRCLYLKTTMGKPVRVF

SEQ ID NO: 5603 - protein, 216 aa, Solanum melongena
MSKLQSEALREAISVIKNDSAEKKRKFSETIELQIGLKNYDPQKDKRFSGSVKLPHIPRPKMKICMLGDAQHVEEAEKIGLEYMDVESLKKLNKNKKLVKKLAKKYHAFLASESVIKQIPRLLGPGLNKAGKFPTLVSHQESLESKVNETKATIKFQLKKVLCMGVAVGNCDMEEKQIFQNVQMSVNFLVSLLKKNWQNVRCLYLKSTMGKTQRIF

SEQ ID NO: 5604 - protein, 216 aa, Solanum melongena
MSKLQSDALREAISVIKNESAEKKRKFSETIELQIGLKNYDPQKDKRFSGSVKLPHIPRPKMKICMLGDAQHVGEAEKIGLEYMDVEGLKKLNKNKKLVKKLAKKYHAFLASESVIKQIPRLLGPGLNKAGKFPTLVSHQESLESKVNETKATIKFQLKKVLCMGVAVGNMDMEEKQIFQNVQMSVNFLVSLLKKNWQNVRCLYLKSTMGKPQRIF

SEQ ID NO: 5605 - protein, 208 aa, Eschscholzia californica
MSKLQSEVLREAITQITADAKEKARKFTETVELQIGLKNYDPQKDKRFSGSVKLPHIPRPKMKVCMLGDAQHVEEAEKIGLDYMDVEGLKKLNKNKKLVKKLAKKFHAFLASEAVIKQIPRLLGPGLNKAGKFPTLVSHQESLEAKVNETKAMVKFQLKKVLCMGVAVGNLGMEEKQIFQNVQLSVNFLVSLLKKNWQNVRCLYLKST

SEQ ID NO: 5606 - protein, 216 aa, Capsicum annuum
MSKLQSEALREAISVIKNESAEKKRNFSETIELQIGLKNYDPQKDKRFSGSVKLPHIPRPKMKICMLGDAQHVGEAEKIGLEYMDVEGLKKLNKNKKLVKKLAKKYHAFLASESVIKQIPRLLGPGLNKAGKFPTLVSHQESLESKVNETKATIKFQLKKVLCMGVAVGNMDMEEKQIFQNVQMSVNFLVSLLKKNWQNVRCLYLKSTMGKPQRIF

SEQ ID NO: 5607 - protein, 216 aa, Capsicum annuum
MSKLQSEAVREAISTIKNDSAEKKRKFSETIELQIGLKNYDPQKDKRFSGSVKLPHIPRPKMKICMLGDAQHVEEAEKIGLEYMDVESLKKLNKNKKLVKKLAKKYHAFLASESVIKQIPRLLGPGLNKAGKFPTLVTHQESLESKVNETKATIKFQLKKVLCMGVAVGNCDMDEKQIFQNVQMSVNFLVSLLKKNWQNVRCLYLKSTMGKTQRVF

SEQ ID NO: 5608 - protein, 216 aa, Raphanus sativus
MSKLQSEALREAITTIKGKSEEKKRNFTETIELQIGLKNYDPQKDKRFSGSVKLPHIPRPKMKVCMLGDAQHVEEAEKMGLDSMDVEALKKLNKNKKLVKKLAKKYHAFLASESVIKQIPRLLGPGLNKAGKFPTLVSHQESLEGKVNETKATVKFQLKKVLCMGVAVGNLSMEEKQLFQNVQMSINFLVSLLKKNWQNVRCLYLKSTMGPPQRIF

SEQ ID NO: 5609 - protein, 217 aa, Setaria italica
MSKLQSEVLKEAISQIVGDSKEKNRKFTETVELQNWSEELMTRRRTSVSVAPLSCPTSPAPKMKVCMLGDAQHVEEAEKIGLDYMDVEALKKMNKNKKLVKKLAKKYHAFLASEAIIKQIPRLLGPGLNKAGKFPTLVTHQESLESKVNETKATVKFQLKKVLCMGVAVGNLSMEEKQIQQNIQMSVNFLVSLLKKNWQNVRCLYIKSTMGKPYRVF

SEQ ID NO: 5610 - protein, 155 aa, Secale cereale
MRVCMLGDAQHVEEAGKMGLDCMDVESLKKMNKNKKLVKKLAKKYHAFLASEAIIKQIPRLLGPGLNKAGKFPTLVSHQESLESKVNETKATVKFQLKKVLCMGVAVGHLGMEEKQIFQNVQMSVNFLVSLLKKNWQNVRCLYLKSTMGKVYRLF

SEQ ID NO: 5611 - protein, 146 aa, Antirrhinum majus
MSKLQSEALREAITVIAADAKEKKRNFTQTIELQIGLKNYDPQKDKRFSGSVKLPHIPRPKMKICMLGDAQHVEEAAKIGLESMDVEALKKLNKNKKLVKKLAKKYHAFLASEAVIKQIPRLLGPGLNKAGKFLLSSLIRNHSSRR

SEQ ID NO: 5612 - protein, 96 aa, Setaria italica
MSKLQSDALREAIASVTNDSREKQRKFVETIELQIGLKNYDPQKDKRFSGSVKLPHIPRPKMKVCMLGDAQHVEEAGRIGLDSMDVEALKKMNKNS

SEQ ID NO: 5613 - protein, 216 aa, Amborella trichopoda
MSKLQSDTLREVISKVVGDAKRKPRKFTETIELQIGLKNYDPQKDKRFSGSVKLPHIPRPKMKLCMLGDAQHVEEAEKMGLDYMDVEGLKKMNKNKKLVKKLAKKYHAFLASEAVIKQIPRLLGPGLNKAGKFPTLVSHQESLEAKVNETKAIVKFQLKKVLCMGVAVGNCAMEEKQVFQNVQMSVNFLVSLLKKNWQNVRCLYLKSTMGRAHPLF

SEQ ID NO: 5614 - protein, 216 aa, Arnica chamissonis
MSKLQSEALREAITQITTDAREKKRNFTETIELQIGLKNYDPQKDKRFSGTVKLPHIPRPKLKVCMLGDAQHVEEAQKIGLEYMDVEGLKKLNKNKKLVKKLAKKHQAFLASESVIKQIPRLLGPGLNKAGKFPTLVSHQESLEAKVNETKATVKFQLKKVLCMGVAVGNCSMEEKQIFQNVQMSVNFLVSLLKKNWQNVRCLYLKTTMGKPVRIF

SEQ ID NO: 5615 - protein, 216 aa, Arnica chamissonis
MSKLQSEALREAITQITTDAKEKKRNFTETVELQIGLKNYDPQKDKRFSGTVKLPHIPRPKLKVCMLGDAQHVEEAQKIGLEYMDVEGLKKLNKNKKLVKKLAKKHQAFLASESVIKQIPRLLGPGLNKAGKFPTLVSHQESLEAKVNETKATVKFQLKKVLCMGVAVGNCSMEEKQIFQNVQMSVNFLVSLLKKNWQNVRCLYLKTTMGKPVRIF

SEQ ID NO: 5616 - protein, 216 aa, Unknown
  Sequence found in Organisms: Brassica napus, Brassica oleracea
MSKLQSEALREAITTIKGKSEDKKRNFVETVELQIGLKNYDPQKDKRFSGSVKLPHIPRPKMKVCMLGDAQHVEEAEKMGLDSMDVEALKKLNKNKKLVKKLAKKYHAFLASESVIKQIPRLLGPGLNKAGKFPTLVSHQESLEGKVNETKATVKFQLKKVLCMGVAVGNLSMEEKQLFQNVQMSINFLVSLLKKNWQNVRCLYLKSTMGPPQRIF

SEQ ID NO: 5617 - protein, 216 aa, Cirsium arvense
MSKLQSEALREAITQITTDAKEKKRNFTETIELQIGLKNYDPQKDKRFSGTVKLPHIPRPKLKVCMLGDAQHVEEAQKIGLEYMDVEGLKKLNKNKKLVKKLAKKHQAFLASESVIKQIPRLLGPGLNKAGKFPTLVTHQESLEAKVNETKATVKFQLKKVLCMGVAVGNCSMEEKQIFQNVQMSVNFLVSLLKKNWQNVRCLYLKTTMGKPVRIF

SEQ ID NO: 5618 - protein, 216 aa, Epimedium sagittatum
MSKLQSDVLRECITKVVERSSTKKRKFTETIELQIGLKNYDPQKDKRFSGSVKLPHIPRPKMKVCMLGDAQHVEEAVKIGLEYMDVEGLKKLNKNKKLVKKLAKKYHAFLASEAVIKQIPRLLGPGLNKAGKFPTLVTHQEALESKVNETKAMVKFQLKKVLCMGVAVGNLGMDEKQIFQNVQLSVNFLVSLLKKNWQNVRCLYLKSSMGRPERIF

SEQ ID NO: 5619 - protein, 216 aa, Eucalyptus grandis
MSKLQSEALREAITGIKNDCNEKKRNFTETIELQIGLKNYDPQKDKRFSGSVKLPHIPRPKMKVCMLGDAQHVEEAEKIGLDYMDVEGLKKLNKNKKLVKRLAKKYHAFLASEAVIKQIPRLLGPGLNKAGKFPTLVTHQESLDAKVNEMKAMVKFQLKKVLCMGVAVGNLSMEDKQIFQNVQLSVNFLVSLLKKNWQNVKCLYLKSSMGKPYRVF

SEQ ID NO: 5620 - protein, 216 aa, Carpinus betulus
MSKLSSDTLKESISTIMAGSKDKKRNFTETIELQIGLKNYDPQKDKRFSGSVKLPHIPRPKMKVCMLGDAQHVEEAEKIGLDYMDVEALKKLNKNKKLVKKLAKKYHAFLASEAVIKQIPRLLGPGLNKAGKFPTLVTHQESIESKVNETKAMVKFQLKKVLCMGVAVGNGAMEEKQIFQNVQMSVNFLVSLLKKNWQNVRSLSLKTTMGKPVRVY

SEQ ID NO: 5621 - protein, 216 aa, Unknown
  Sequence found in Organisms: Thellungiella halophila, Eutrema halophilum
MSKLQSEAVREAITVIRAKSDEKKRNFVETLELQIGLKNYDPQKDKRFSGSVKLPHIPRPKMKICMLGDAQHVEEADKMGLDYMDVESLKKLNKNKKLVKKLAKKYHAFLASESVIKQIPRLLGPGLNKAGKFPTLVSHQESLESKVNETKATVKFQLKKVLCMGVAVGNLSMEEKQIFQNVQMSVNFLVSLLKKNWQNVRCLYLKSTMGPPQRIF

SEQ ID NO: 5622 - protein, 214 aa, Eutrema parvulum
KLQSEALREAITTVKGKSEEKKRNFVETVELQIGLKNYDPQKDKRFSGSVKLPHIPRPKMKICMLGDAQHVEEAEKMGLDYMDVEGLKKLNKNKKLVKKLAKKYHAFLASESVIKQIPRLLGPGLNKAGKFPTLVSHQESLEAKVNETKATVKFQLKKVLCMGVAVGNLSMEEKQLFQNVQMSVNFLVSLLKKNWQNVRCLYLKSTMGPPQRIF

SEQ ID NO: 5623 - protein, 216 aa, Trigonella foenum-graecum
MSKLQSEAVREAISGIMGDSKEKNRKFVETIELQIGLKNYDPQKDKRFSGSVKLPHIPRPKMKICMLGDAQHVEEAEKIGLESMDVEALKKLNKNKKLVKKLAKKYHAFLASEAVIKQIPRLLGPGLNKAGKFPTLVSHQESLEGKVNETKAMVKFQLKKVLCMGVAVGNVSMDEKQIFQNVQLSVNFLVSLLKKNWQNVRCLYLKSSMGKSYRVF

SEQ ID NO: 5624 - protein, 216 aa, Brachypodium distachyon
MSKLQSEALREAITSITTNSRDKQRKFIETIELQIGLKNYDPQKDKRFSGSVKLPHIPRPKMRVCMLGDAQHVEEAGKLGLDCMDVESLKKMNKNKKLVKKLAKKYHAFLASEAIIKQIPRLLGPGLNKAGKFPTLVSHQESLESKVNETKATVKFQLKKVLCMGVAVGHCGMDEKQIFQNVQMSVNFLVSLLKKNWQNVRCLYLKSTMGKMHRLF

SEQ ID NO: 5625 - protein, 216 aa, Unknown
  Sequence found in Organisms: Centaurea maculosa, Carthamus tinctorius
MSKLQSEALREAITQITTDAKEKKRNFTETIELQIGLKNYDPQKDKRFSGTVKLPHIPRPKLKVCMLGDAQHVEEAQKIGLEYMDVEALKKLNKNKKLVKKLAKKHQAFLASESVIKQIPRLLGPGLNKAGKFPTLVTHQESLEAKVNETKATVKFQLKKVLCMGVAVGNCSMEDKQIFQNVQMSVNFLVSLLKKNWQNVRCLYLKTTMGKPVRIF

SEQ ID NO: 5626 - protein, 216 aa, Unknown
  Sequence found in Organisms: Castanea mollissima, Quercus alba
MSKLQSDTLREVISQVVNNAKEKKRNFTETIELQIGLKNYDPQKDKRFSGSVKLPHIPRPKMKICMLGDAQHVEEAEKVGLEYMDVEGLKKLNKNKKLVKKLAKKYHAFLASESVIKLIPRLLGPGLNKAGKFPTLVTHQESLESKVNETKAMVKFQLKKVLCMGVAVGNCSMEEKQIFQNVQMSVNFLVSLLKKNWQNVRCLNLKSTMGSAVRLY

SEQ ID NO: 5627 - protein, 216 aa, Unknown
  Sequence found in Organisms: Cucumis sativus, Cucumis melo
MSKLQSDALREAISSIFTDSNEKKRKFTETIELQIGLKNYDPQKDKRFSGSVKLPHIPRPKMKICMLGDASHIEEAEKIGLEYMDVEGLKKLNKNKKLVKKLAKKYHAFLASESIIKQIPRLLGPGLNKAGKFPTLVTHQETLESKVNETKAMVKFQLKKVLCMGVAVGNVSMDEKQVFQNVQMSVNFLVSLLKKNWQNVRCLYLKSTMGKSYRVF

SEQ ID NO: 5628 - protein, 216 aa, Taraxacum officinale
MSKLQSEALREAITQITTDAKEKSRKFTETIELQIGLKNYDPQKDKRFSGTVKLPHIPRPKLKVCMLGDAQHVEEAQKIGLEYMDVEGLKKLNKNKKLVKKLAKKHQAFLASESVIKQIPRLLGPGLNKAGKFPTLVSHQESLEAKVNETKATVKFQLKKVLCMGVAVGNCSMEEKQIFQNVQMSVNFLVSLLKKNWQNVRCLYLKTTMGKPVRIF

SEQ ID NO: 5629 - protein, 204 aa, Actinidia deliciosa
MSKLQSEALREAISQISNDAKEKKRNFTETIELQIGLKNYDPQKDKRFSGSVKLPHIPRPKMKVCMLGDAQHVEEAEKIGLEYMDVEGLKKLNKNKKLVKKLAKKYHAFLASEAVIKQIPRLLGPGLNKAGKFPTLVTHQESLESKVNETKATVKFQLKKVLCMGVAVGNCSMEEKQIFQNVQMSVNFLVSLLKKNWQNVRCLY

SEQ ID NO: 5630 - protein, 216 aa, Medicago truncatula
MSKLQSEAVREAISGIMADSKEKNRKFVETIELQIGLKNYDPQKDKRFSGSVKLPHIPRPKMKLCMLGDAQHVEEAEKIGLESMDVEALKKLNKNKKLVKKLAKKYHAFLASEAVIKQIPRLLGPGLNKAGKFPTLVSHQESLEGKVNETKAMVKFQLKKVLCMGVAVGNVSMDEKQIFQNVQLSVNFLVSLLKKNWQNVRCLYLKSSMGKSYRVF

SEQ ID NO: 5631 - protein, 216 aa, Unknown
  Sequence found in Organisms: Solanum lycopersicum, Medicago truncatula, Solanum tuberosum, Solanum phureja
MSKLQSDALREAITVIKNDSSEKKRKFTETIELQIGLKNYDPQKDKRFSGSVKLPHIPRPKMKICMLGDAQHVGEAEKIGLEYMDVEGLKKLNKNKKLVKKLAKKYHAFLASEAVIKQIPRLLGPGLNKAGKFPTLVSHQESLESKVNETKATIKFQLKKVLCMGVAVGNMDMEEKQIFQNVQMSVNFLVSLLKKNWQNVRCLYLKSTMGKTQRIF

SEQ ID NO: 5632 - protein, 216 aa, Unknown
  Sequence found in Organisms: Solanum tuberosum, Solanum phureja
MSKLQSEALREAISIIKNDSAEKKRKFSETIELQIGLKNYDPQKDKRFSGSVRLPHIPRPKMKICMLGDAQHVGEAEKIGLEYMDVESLKKLNKNKKLVKKLAKKYHAFLASESVIKQIPRLLGPGLNKAGKFPTLVSHQESLESKVNETKATIKFQLKKVLCMGVAVGNCDMEEKQIFQNVQMSVNFLVSLLKKNWQNVRCLYLKSTMGKTQRVF

SEQ ID NO: 5633 - protein, 216 aa, Fragaria vesca
MSKLQSDTLREAISVIMAASKEKNRKFTETIELQIGLKNYDPQKDKRFSGSVKLPHIPRPKMKVCMLGDAQHVEEAQKIGLEYMDVEALKKLNKNKKLVKKLAKKYHAFLASEAVIKQIPRLLGPGLNKAGKFPTLVSHQESLESKISETKATIKFQLKKVLCMGVAVGNVSMEEKQIFQNVQLSVNFLVSLLKKNWQNVKCLNLKTTMGKPYRVY

SEQ ID NO: 5634 - protein, 216 aa, Solanum lycopersicum
MSKLQSEALREAISVIKNDSAEKKRKFSETIELQIGLKNYDPQKDKRFSGSVRLPHIPRPKMKICMLGDAQHVGEAEKIGLEYMDVESLKKLNKNKKLVKKLAKKYHAFLASESVIKQIPRLLGPGLNKAGKFPTLVSHQESLESKVNETKATIKFQLKKVLCMGVAVGNCDMEEKQIFQNVQMSVNFLVSLLKKNWQNVRCLYLKSTMGKTQRVF

SEQ ID NO: 5635 - protein, 216 aa, Solanum lycopersicum
MSKLQSEALREAISVIKNDSAEKKRKFSETIELQIGLKNYDPQKDKRFSGSVKLPHIPRPKMKICMLGDAQHVGEAEKIGLEYMDVEGLKKLNKNKKLVKKLAKKYHAFLASESVIKQIPRLLGPGLNKAGKFPTLVSHQESLESKVNETKATIKFQLKKVLCMGVAVGNMDMEEKQIFQNVQMSVNFLVSLLKKNWQNVRCLYLKSTMGKTQRIF

SEQ ID NO: 5636 - protein, 216 aa, Tragopogon dubius
MSKLQSEALREAITQITTDAKEKKRNFTETIELQIGLKNYDPQKDKRFSGTVKLPHIPRPKLKVCMLGDAQHVEEAQKIGLEYMDVEALKKLNKNKKMVKKLAKKHQAFLASESVIKQIPRLLGPGLNKAGKFPTLVTHQESLEGKVNETKATVKFQLKKVLCMGVAVGNCSMEEKQIFQNVQMSVNFLVSLLKKNWQNVRCLYLKTTMGKPVRIF

SEQ ID NO: 5637 - protein, 216 aa, Tragopogon dubius
MSKLQSEALREAITQITTDAKEKKRNFTETIELQIGLKNYDPQKDKRFSGTVKLPHIPRPKLKVCMLGDAQHVEEAQKIGLEYMDVEGLKKLNKNKKLVKKLAKKHQAFLASESVIKQIPRLLGPGLNKAGKFPTLVTHQESLEGKVNETKATVKFQLKKVLCMGVAVGNCSMEEKQIFQNVQMSVNFLVSLLKKNWQNVRCLYLKTTMGKPVRIF

SEQ ID NO: 5638 - protein, 216 aa, Triphysaria pusilla
MSKLQSDALREAITQIVSDCKEKKRNFVETVELQIGLKNYDPQKDKRFSGSVKLPHIPRPKMKICMLGDAQHVEEATKIGLESMDVEALKKLNKNKKLVKKLAKKYHAFLASESVIKQIPRLLGPGLNKAGKFPTLVSHQESLEAKVNETKATIKFQLKKVLCMGVAVGNLDMEEKQIFQNVQMSINFLVSLLKKNWQNVRCLYLKSTMGKTQRIF

SEQ ID NO: 5639 - protein, 94 aa, Fraxinus spp
MKICMLGDAQHVEEAEKIGLESMDVEALKKLKQKTRSWLKKLDKRNINAFLASEAVIKQIPRLLGPGLNKAGKFPTLCHTRNLLNPRSMRRRPQ

SEQ ID NO: 5640 - protein, 216 aa, Amborella trichopoda
MSKLQSDTLREVIGKVMGDAKKKNRKFTETIELQIGLKNYDPQKDKRFSGSVKLPHVPRPKMKVCMLGDAQHVEEAEKMGLDYMDVEGLKKLNKNKKLVKKLAKKYHAFLASEAVIKQIPRLLGPGLNKAGKFPTLVSHQESLESKVNETKAIVKFQLKKVLCMGVAVGNCAMEEKQVFQNVQMSVNFLVSLLKKNWQNVRSLYLKSTMGKAHPLF

SEQ ID NO: 5641 - protein, 216 aa, Ambrosia trifida
MSKLQSEALREAITQITTDAKEKKRNFTETIELQIGLKNYDPQKDKRFSGTVKLPHIPRPKLKVCMLGDAQHVEEAQKIGLEYMDVESLKKLNKNKKLVKKLAKKHQAFLASESVIKQIPRLLGPGLNKAGKFPTLVSHQESLEAKVNETKATVKFQLKKVLCMGVAVGNCSMEEKQIFQNVQMSVNFLVSLLKKNWQNVRCLYLKTTMGKPVRIF

SEQ ID NO: 5642 - protein, 216 aa, Ambrosia trifida
MSKLQSEALREAITQITTDAREKKRNFTETIELQIGLKNYDPQKDKRFSGTVKLPHIPRPKLKVCMLGDAQHVEEAQKIGLEYMDVESLKKLNKNKKLVKKLAKKHQAFLASESVIKQVPRLLGPGLNKAGKFPTLVSHQESLEAKVNETKATVKFQLKKVLCMGVAVGNCSMEEKQIFQNVQMSVNFLVSLLKKNWQNVRCLYLKTTMGKPVRIF

SEQ ID NO: 5643 - protein, 216 aa, Ambrosia trifida
MSKLQSEALREAITQITTAANEKKRNFTETIELQIGLKNYDPQKDKRFSGTVKLPHIPRPKLKVCMLGDAQHVEEAQKIGLEYMDVESLKKLNKNKKLVKKLAKKHQAFLASESVIKQIPRLLGPGLNKAGKFPTLVSHQESLEAKVNETKATVKFQLKKVLCMGVAVGNCSMEEKQIFQNVQMSVNFLVSLLKKNWQNVRCLYLKTTMGKPIRIF

SEQ ID NO: 5644 - protein, 216 aa, Ambrosia trifida
MSKLQSEALREAITQITTNATEKKRNFTETIELQIGLKNYDPQKDKRFSGTVKLPHIPRPKLKVCMLGDAQHVEEAQKIGLEYMDVEGLKKLNKNKKLVKKLAKKHQAFLASESVIKQIPRLLGPGLNKAGKFPTLVSHQESLEAKVNETKATVKFQLKKVLCMGVAVGNCSMEEKQIFQNVQMSVNFLVSLLKKNWQNVRCLYLKTTMGKPIRIF

SEQ ID NO: 5645 - protein, 216 aa, Ambrosia trifida
MSKLQSEALREAITQITTAATEKKRNFTETIELQIGLKNYDPQKDKRFSGTVKLPHIPRPKLKVCMLGDAQHVEEAQKIGLEYMDVESLKKLNKNKKLVKKLAKKHQAFLASESVIKQIPRLLGPGLNKAGKFPTLVSHQESLEAKVNETKATVKFQLKKVLCMGVAVGNCSMEEKQIFQNVQMSVNFLVSLLKKNWQNVRCLYLKTTMGKPIRIF

SEQ ID NO: 5646 - protein, 216 aa, Unknown
  Sequence found in Organisms: Arnica chamissonis, Cichorium intybus, Taraxacum officinale, Lactuca sativa, Helianthus annuus
MSKLQSEALREAITQITTDAKEKKRNFTETIELQIGLKNYDPQKDKRFSGTVKLPHIPRPKLKVCMLGDAQHVEEAQKIGLEYMDVEGLKKLNKNKKLVKKLAKKHQAFLASESVIKQIPRLLGPGLNKAGKFPTLVSHQESLEAKVNETKATVKFQLKKVLCMGVAVGNCSMEEKQIFQNVQMSVNFLVSLLKKNWQNVRCLYLKTTMGKPVRIF

SEQ ID NO: 5647 - protein, 216 aa, Unknown
  Sequence found in Organisms: Brassica napus, Brassica juncea, Brassica rapa
MSKLQSEALREAITTIKGKSEDKKRNFVETIELQIGLKNYDPQKDKRFSGSVKLPHIPRPKMKVCMLGDAQHVEEAEKMGLDSMDVEALKKLNKNKKLVKKLAKKYHAFLASESVIKQIPRLLGPGLNKAGKFPTLVSHQESLEGKVNETKATVKFQLKKVLCMGVAVGNLSMEEKQLFQNVQMSINFLVSLLKKNWQNVRCLYLKSTMGPPQRIF

SEQ ID NO: 5648 - protein, 216 aa, Unknown
  Sequence found in Organisms: Centaurea maculosa, Cirsium arvense, Cynara scolymus, Gerbera hybrid cultivar, Carthamus tinctorius
MSKLQSEALREAITQITTDAKEKKRNFTETIELQIGLKNYDPQKDKRFSGTVKLPHIPRPKLKVCMLGDAQHVEEAQKIGLEYMDVEGLKKLNKNKKLVKKLAKKHQAFLASESVIKQIPRLLGPGLNKAGKFPTLVTHQESLEAKVNETKATVKFQLKKVLCMGVAVGNCSMEDKQIFQNVQMSVNFLVSLLKKNWQNVRCLYLKTTMGKPVRIF

SEQ ID NO: 5649 - protein, 216 aa, Flaveria ramosissima
MSKLQSDALREAITQITTDAKEKKRNFTETIELQIGLKNYDPQKDKRFSGTVKLPHIPRPKLKVCMLGDAQHVEEAQKIGLEYMDVESLKKLNKNKKLVKKLAKKHQAFLASESVIKQIPRLLGPGLNKAGKFPTLVTHQESLEAKVNETKATVKFQLKKVLCMGVAVGNCSMEEKQIFQNVQMSVNFLVSLLKKNWQNVRCLYLKTTMGKPVRIF

SEQ ID NO: 5650 - protein, 216 aa, Flaveria ramosissima
MSKLQSDALREAITQITTDAKEKKRNFTETIELQIGLKNYDPQKDKRFSGTVKLPHIPRPKLKVCMLGDAQHVEEAQKIGLEYMDVEGLKKLNKNKKLVKKLAKKHQAFLASESVIKQIPRLLGPGLNKAGKFPTLVTHQESLEAKVNETKATVKFQLKKVLCMGVAVGNCSMEEKQIFQNVQMSVNFLVSLLKKNWQNVRCLYLKTTMGKPVRIF

SEQ ID NO: 5651 - protein, 216 aa, Arabidopsis lyrata
MSKLQSEAVREAITIITGKSDAKKRNFVETVELQIGLKNYDPQKDKRFSGSVKLPHIPRPKMKICMLGDAQHVEEAEKMGLENMDVESLKKLNKNKKLVKKLAKKYHAFLASESVIKQIPRLLGPGLNKAGKFPTLVSHQESLESKVNETKATVKFQLKKVLCMGVAVGNLSMEEKQIFQNVQMSVNFLVSLLKKNWQNVRCLYLKSTMGPPQRIF

SEQ ID NO: 5652 - protein, 216 aa, Arabidopsis lyrata
MSKLQSEALREAITTIKGKSEEKKRNFVETVELQIGLKNYDPQKDKRFSGSVKLPHIPRPKMKICMLGDAQHVEEAEKMGLSNMDVEALKKLNKNKKLVKKLAKSYHAFLASESVIKQIPRLLGPGLNKAGKFPTLVSHQESLEAKVNETKATVKFQLKKVLCMGVAVGNLSMEEKQLFQNVQMSVNFLVSLLKKNWQNVRCLYLKSTMGPPQRIF

SEQ ID NO: 5653 - protein, 216 aa, Lactuca sativa
MSKLQSEALREAITQITTDAKEKKRNFTETIELQIGLKNYDPQKDKRFSGTVKLPHIPRPKLKVCMLGDAQHVEEAQKIGLEYMDVEGLKKLNKNKKLVKKLAKKHQAFLASESVIKQIPRLLGPGLNKAGKFPTLVSHQESLEGKVNETKATVKFQLKKVLCMGVAVGNCSMEEKQIFQNVQMSVNFLVSLLKKNWQNVRCLYLKTTMGKPVRIF

SEQ ID NO: 5654 - protein, 216 aa, Parthenium argentatum
MSKLQSEALREAITQITTDAKEKKRNFTETIELQIGLKNYDPQKDKRFSGTVKLPHIPRPKLKVCMLGDAQHVEEAQKIGLEYMDVEGLKKLNKNKKLVKKLAKKHQAFLASESVIKQIPRLLGPGLNKAGKFPTLVTHQDSLEAKVNETKATVKFQLKKVLCMGVAVGNCSMEEKQIFQNVQMSVNFLVSLLKKNWQNVRCLYLKTTMGKPVRIF

SEQ ID NO: 5655 - protein, 216 aa, Unknown
  Sequence found in Organisms: Solanum tuberosum, Solanum phureja
MSKLQSEALREAITVIKNDSAEKKRKFSETIELQIGLKNYDPQKDKRFSGSVKLPHIPRPKMKICMLGDAQHVGEAEKIGLEYMDVEGLKKLNKNKKLVKKLAKKYHAFLASESVIKQIPRLLGPGLNKAGKFPTLVSHQESLESKVNETKATIKFQLKKVLCMGVAVGNMDMEEKQIFQNVQMSVNFLVSLLKKNWQNVRCLYLKSTMGKTQRIF

SEQ ID NO: 5656 - protein, 216 aa, Raphanus sativus
MSKLQSEAVKEAITVIRGKSEEKKRNFVETLELQIGLKNYDPQKDKRFSGSVKLPHIPRPKMKICMLGDAQHVEEAEKMGLDSMDVESLKKLNKNKKLVKKLAKKYHAFLASESVIKQIPRLLGPGLNKAGKFPTLVSHQESLEGKVNETKATVKFQLKKVLCMGVAVGNLSMEEKHIFQNVQMSVNFLVSLLKKNWQNVRCLYLKSTMGPPQRIF

SEQ ID NO: 5657 - protein, 216 aa, Triphysaria pusilla
MSKLQSEALREAITQIVSDCKEKKRNFVETIELQIGLKNYDPQKDKRFSGSVKLPHIPRPKMKICMLGDAQHVEEAAKIGLESMDVEALKKLNKNKKLVKKLAKNYHAFLASESVIKQIPRLLGPGLNKAGKFPTLVSHQESLEAKVNETKATIKFQLKKVLCMGVAVGNLDMEEKQIFQNVQMSINFLVSLLKKNWQNVRCLYLKSTMGKTQRIF

SEQ ID NO: 5658 - protein, 216 aa, Juglans hindsii x Juglans regia
  misc_feature (18)..(18): Xaa can be any naturally occurring amino acid
MSKLQSDAVREAISTLFXGSREKKRNFTETVELQIGLKNYDPQKDKRFSGSVKLPHIPRPKMKVCMLGDAQHVEEAEKIGLDYMDVEALKKLNKNKKLVKKLAKKYHAFLASEAVIKQIPRLLGPGLNKAGKFPTLVTHQETIESKVNETKAMVKFQLKKVLCMGVAVGNVAMEEKQVFQNVQMSVNFLVSLLKKNWQNVRSLSLKTTMGRPVRIY

SEQ ID NO: 5659 - protein, 216 aa, Medicago truncatula
MSKLQSEAVREAITGIMADSKEKNRKFVETIELQIGLKNYDPQKDKRFSGSVKLPHIPRPKMKICMLGDAQHVEEAEKIGLESMDVEALKKLNKNKKLVKKLAKKYHAFLASEAVIKQIPRLLGPGLNKAGKFPTLVSHQESLEAKVNETKAMVKFQLKKVLCMGVAVGNVSMDEKQIFQNVQLSVNFLVSLLKKNWQNVRCLYLKSSMGKSYRVF

SEQ ID NO: 5660 - protein, 146 aa, Brassica napus
MSKLQSEALREAITTIKGKSEDKKRNFVETIELQIGLKNYDPQKDKRFSGSVKLPHIPRPKMKVCMLGDAQHVEEAEKMGLDSMDVEALKKLNKNKKLVKKLAKKYHAFLASESVIKQIPRLLGPGLNKAGKFPTLVSHQESLEGR

SEQ ID NO: 5661 - protein, 92 aa, Arachis hypogaea
MSKLQSDALREAITGIVADSKEKNRKFVETIELQIGLKNSDPQKDKRFSGSVKLPHIPRPKMKICMLGDAQHVEEAEENRLDWMDVEALEKA

SEQ ID NO: 5662 - protein, 595 aa, Prunus persica
MSLPLVLLTILTFSALSATASASDRSYNVGDHVPLFVNKVGPLNNPSETYQYYDLPFCCPDPVIQKKESIGEVLNGDRLANTLYQLNFRQDKNGESLCQKKLKVAEVAKFRDAIVNDFYFQMYYDDLPVWGFIGKVEDESWTISDKGTKYYLFKHVLFDVFYNGNQIIEIRAFSDPNHVADITEDVDIDVEFTYSVKWNATSIQFQNRMDRYSKASLLPVRLKIHWFSFINSIVIIVLLMGLLTLLIMRRLKNDLRKCSNDEEEDKEVGWKYIHGDVFRYPSNMPLFCAVLGVGTQLLIMVCILFFLSFFGVLYPYNRGALFTSLVFICTLTSIVAGYTAAAFHTQFSVIGWERSVLLTAILYLGPLFVTSSILNTVAISYGATAAIPFGTLLAILLIYAFLAIPLLALGGVIGYCLRSEFQAPCATKQFPREIQRLAWYRRTHCQMFIGGLLPFSAIALQLHHLYASMWGYKIYTLPGILFLTFIILIIMTSILTVGLTYIQLSVEDHEWWWRSVLSGGSTAIFMFAYSIYFYARSNMTGFMQLSFFIGYNACMCYAFFLMLGAISFRVSLIFVRHIYGDVDNSLAIHPYIHDV

SEQ ID NO: 5663 - protein, 218 aa, Plantago ovata
MSKLSSDATKEAITSIMADATDPEKKKNFTETIELQIGLKNYDPQKDKRFSGSVKLPHIPRPKMKICMLGDAQHVEEAEKIGLESMDVEALKKLNKNKKLVKKLAKKYHAFLASESVIKQIPRLLGPGLNKAGKFPTLVSHQESLESKVNETKATVKFQLKKVLCMGVAVGNCGMEEKQIFQNVQMSVNFLVSLLKKNWQNVRCLYLKSTMGKPVRIF

SEQ ID NO: 5664 - protein, 238 aa, Eragrostis curvula
MKNVAKCDTWCELQNPANHRVFERKLQTEVLKDGIANVVKDAKEKNRKFTETIELQIGLKNYDPQKDKRFSGSVKLPHIPRPKMKVCMLGDAQHVEEAEKMGLDYMDVESLKKMNKNKKLVKKLAKKYHAFLASEAIIKQIPRLLGPGLNKAGKFPTLVSHQESLESKVNETKATVKFQLKKVLCMGVAVGNLSMEEKQIQQNIQMSVNFLVSLLKKNWQNVRCLYIKSTMGKPYRLF

SEQ ID NO: 5665 - protein, 148 aa, Theobroma cacao
MSKLQSDAVREAISTIVGDSKEKQRKFVETIELQIGLKNYDPQKDKRFSGAVKLPHIPRPKMKICMLGDALHVEEAEKIGLDWMDVEALKKLNKNKKLVKKLAKKYHAFLASEAVIKQIPRLLGPGLNKAGKEVPNTCHTSGISGVKS

SEQ ID NO: 5666 - protein, 61 aa, Ambrosia trifida
MSKLQSEALREAITQITTDAKERNVTSPRPLSFRSGSRTTTHKRTNVLAVLLSCLTFLVLN

SEQ ID NO: 5667 - protein, 151 aa, Ambrosia trifida
MLGDAQHVEEAQKIGLEYMDVEGLKKLNKNKKLVKKLAKKHQAFLASESVIKQIPRLLGPGLNKAGKFPTLVSHQESLEAKVNETKATVKFQLKKVLCMGVAVGNCSMEEKQIFQNVQMSVNFLVSLLKKNWQNVRCLYLKTTMGKPIRIF

SEQ ID NO: 5668 - protein, 103 aa, Arnica chamissonis
MSKLQSEALREAITQITTDAKEKKRNFTETIELQIGLKNYDPQKDKRFSGTVKLPHIPRPKLKVCMLGDAQHVEEAQKIGLEYMDVESLKKLNKNKKLVKKLD

SEQ ID NO: 5669 - protein, 233 aa, Brassica rapa
MVLSLMDYSKLQSEAVKEAITVIRGKSEDKKRNFVETLELQIGLKNYDPQKDKRFSGSVKLPHIPRPKMKICMLGDAQHVEEAEKMGLDYMDVESLKKLNKNKKLVKKLAKKYHAFLASESVIKQIPRLLGPGLNKAGKFPTLVSHQESLEGKVNETKATVKFQLKKVLCMGVAVGNLSMEEKQIFQNVQMSVNFLVSFLEEELAKCEVFVPQEHNGTTSKNLLSSCSSVNGG

SEQ ID NO: 5670 - protein, 151 aa, Flaveria ramosissima
MLGDAQHVEEAQKIGLEYMDVEGLKKLNKNKKLVKKLAKKHQAFLASESVIKQIPRLLGPGLNKAGKFPTLVTHQESLEAKVNETKATVKFQLKKVLCMGVAVGNCSMEEKQIFQNVQMSVNFLVSLLKKNWQNVRCLYLKTTMGKPVRIF

SEQ ID NO: 5671 - protein, 249 aa, Eutrema parvulum
MILFGTVYNGVCSNYTSVTVFCLCYLLGTGLVVYSKLQSEAVREAITVIRGKSEEKKRNFVETLELQIGLKNYDPQKDKRFSGSVKLPHIPRPKMKICMLGDAQHVEEADKMGLDYMDVESLKKLNKNKKLVKKLAKKYHAFLASESVIKQIPRLLGPGLNKAGKFPTLVSHQESLEAKVNETKATVKFQLKKVLCMGVAVGNLSMEEKQIFQNVQMSVNFLVSLLKKNWQNVRCLYLKSTMGPPQRIF

SEQ ID NO: 5672 - protein, 155 aa, Amborella trichopoda
MKLCMLGDAQHVEEAEKMGLDYMDVEGLKKMNKNKKLVKKLAKKYHAFLASEAVIKQIPRLLGPGLNKAGKFPTLVSHQESLEAKVNETKAIVKFQLKKVLCMGVAVGNCAMEEKQVFQNVQMSVNFLVSLLKKNWQNVRCLYLKSTMGRAHPLF

SEQ ID NO: 5673 - protein, 238 aa, Raphanus sativus
  misc_feature (34)..(34): Xaa can be any naturally occurring amino acid
  misc_feature (223)..(223): Xaa can be any naturally occurring amino acid
  misc_feature (232)..(232): Xaa can be any naturally occurring amino acid
MSKLQSEAVKEAITVIRGKSEEKKRNFVETLELXIGLKNYDPQKDKRFSGSVKLPHIPRPKMKICMLGDAQHVEEAEKMGLDSMDVESLKKLNKNKKLVKKLAKKYHAFLASESVIKQIPRLLGPGLNKAGKFPTLVSHQESLEGKVNETKATVKFQLKKVLCMGVAVGNLSMEEKHIFQNVQMSVNFLVSLLKKNWQNVRCLYLKSTMGHHKESSELSQLLXWWLLHLPFXFYFRHI

SEQ ID NO: 5674 - protein, 216 aa, Ambrosia trifida
MSKLQSEALREAITQITTAAKENKRNFTETIELQIGLKNYDPQKDKRFSGTVKLPHIPRPKLKVCMLGDAQHVEEAQKIGLEYMDVESLKKLNKNKKLVKKLAKKHQAFLASESVIKQIPRLLGPGLNKAGKFPTLVSHQESLEAKVNETKATVKFQLKKVLCMGVAVGNCSMEEKQIFQNVQMSVNFLVSLLKKNWQNVRCLYLKTTMGKPIRIF

SEQ ID NO: 5675 - protein, 216 aa, Fagus grandifolia
MSKLQSDTLREVISQVVNNAKEKKRNFTETIELQIGLKNYDPQKDKRFSGSVKLPHIPRPKMKLCMLGDAQHVEEAEKVGLEYMDVEGLKKLNKNKKLVKKLAKKYHAFLASESVIKLIPRLLGPGLNKAGKFPTLVTHQESLESKVNETKAMVKFQLKKVLCMGVAVGNCGMEEKQIFQNVQMSINFLVSLLKKNWQNVRCLNLKSTMGSAVRLY

SEQ ID NO: 5676 - protein, 216 aa, Ricinus communis
MSKLQSEALREAITTIMTASKEKKRKFTETIELQIGLKNYDPQKDKRFSGSVKLPHIPRPKMKICMLGDAQHVEEAEAIGLQWMDVEALKKLNKNKKLVKKLAKQYHAFLASESVIKQIPRLLGPGLNKAGKFPTLVNHQESLESKVNETKATVKFQLKKVLCMGVAVGNCSMEEKQVFQNVQMSVNFLVSLLKKNWQNVKCLNLKTTMGSPQRVF

SEQ ID NO: 5677 - protein, 216 aa, Epimedium sagittatum
MSKLQSDVLRECITKIVERSNTKKRKFTETIELQIGLKNYDPQKDKRFSGSVKLPHIPRPKMKVCMLGDAQHVEEAVKIGLEFMDVEGLKKLNKNKKLVKKLAKKYHAFLASEAVIKQIPRLLGPGLNKAGKFPTLVTHQEALESKVNETKAMVKFQLKKVLCMGVAVGNLGMDEKQIFQNVQLSVNFLVSLLKKNWQNVRCLYLKSSMGRPERIF

SEQ ID NO: 5678 - protein, 216 aa, Helianthus annuus
MSKLQSEALREAITQITTDAKEKKRNFTETIELQIGLKNYDPQKDKRFSGTVKLPHIPRPKLKACMLGDAQHVEEAQKIGLEYMDVEGLKKLNKNKKLVKKLAKKHQAFLASESVIKQIPRLLGPGLNKAGKFPTLVSHQESLEAKVNETKATVKFQLKKVLCMGVAVGNCSMEEKQIFQNVQMSVNFLVSLLKKNWQNVRCLYLKTTMGKPVRIF

SEQ ID NO: 5679 - protein, 204 aa, Thalictrum flavum
ITQVTGEAKEKKRKFTETVELQIGLKNYDPQKDKRFSGSVKLPHIPRPKMKICMLGDAQHVEEAEKIGLEYMDVEGLKKLNKNKKLVKKLAKKYHAFLASEAVIKQIPRLLGPGLNKAGKFPTLVTHQESLESKVNESKAMVKFQLKKVLCMGVAVGNLGMDEKQIFQNVQLSVNFLVSLLKKNWQNVRCLYLKSSMGKPFRIF

SEQ ID NO: 5680 - protein, 216 aa, Trigonella foenum-graecum
MSKLQSDAVREAITGIMADSKEKNRKFVETIELQIGLKNYDPQKDKRFSGSVKLPHIPRPKMKICMLGDAQHVEEAEKIGLESMDVEALKKLNKNKKLVKKLAKKYHAFLASEAVIKQIPRLLGPGLNKAGKFPTLVSHQESLEAKVNETKAMVKFQLKKVLCMGVAVGNVSMDEKQIFQNVQLSVNFLVSLLKKNWQNVRCLYLKSSMGKSYRVF

SEQ ID NO: 5681 - protein, 216 aa, Arabidopsis thaliana
MSKLQSEAVREAITTITGKSEAKKRNFVETIELQIGLKNYDPQKDKRFSGSVKLPHIPRPKMKICMLGDAQHVEEAEKMGLENMDVESLKKLNKNKKLVKKLAKKYHAFLASESVIKQIPRLLGPGLNKAGKFPTLVSHQESLESKVNETKATVKFQLKKVLCMGVAVGNLSMEEKQIFQNVQMSVNFLVSLLKKNWQNVRCLYLKSTMGPPQRIF

SEQ ID NO: 5682 - protein, 216 aa, Arabidopsis thaliana
MSKLQSEAVREAITTIKGKSEEKKRNFVETVELQIGLKNYDPQKDKRFSGSVKLPHIPRPKMKICMLGDAQHVEEAEKMGLSNMDVEALKKLNKNKKLVKKLAKSYHAFLASESVIKQIPRLLGPGLNKAGKFPTLVSHQESLEAKVNETKATVKFQLKKVLCMGVAVGNLSMEEKQLFQNVQMSVNFLVSLLKKNWQNVRCLYLKSTMGPPQRIF

SEQ ID NO: 5683 - protein, 216 aa, Manihot esculenta
MSKLQSEALREAISTIMTASKEKKRNFTETIELQIGLKNYDPQKDKRFSGSVKLPHIPRPKMKICMLGDAQHVEEAEGIGLQWMDVEALKKLNKNKKLVKKLAKQYHAFLASESVIKQIPRLLGPGLNKAGKFPTLVTHQESLESKVNETKATVKFQLKKVLCMGVAVGNCAMEEKQVFQNVQMSVNFLVSLLKKNWQNVKCLHLKTTMGAPQRVF

SEQ ID NO: 5684 - protein, 216 aa, Ricinus communis
MSKLQSEALREAITTIMAASKEKKRKFTETIELQIGLKNYDPQKDKRFSGSVKLPHIPRPKMKICMLGDAQHVEEAEAIGLQWMDVEALKKLNKNKKLVKKLAKQYHAFLASESVIKQIPRLLGPGLNKAGKFPTLVTHQESLESKVNETKATVKFQLKKVLCMGVAVGNCSMEEKQVFQNVQMSVNFLVSLLKKNWQNVKCLNLKTTMGTPQRIF

SEQ ID NO: 5685 - protein, 216 aa, Cichorium intybus
MSKLQSDALREAITQITTDAKEKKRNFTETIELQIGLKNYDPQKDKRFSGTVKLPHIPRPKLKVCMLGDAQHVEEAQKIGLEYMDVEGLKKLNKNKKLVKKLAKKHQAFLASESVIKQIPRLLGPGLNKAGKFPTLVSHQESLEAKVNETKATVKFQLKKVLCMGVAVGNCSMEEKQIFQNVQMSVNFLVSLLKKNWQNVRCLYLKTTMGKPVRIF

SEQ ID NO: 5686 - protein, 216 aa, Trifolium pratense
MSKLQSEAVREAISGIMTDSKDKNRKFVETIELQIGLKNYDPQKDKRFSGSVKLPHIPRPKMKICMLGDAQHVEEAEKIGLESMDVEALKKLNKNKKLVKKLAKKYQAFLASEAVIKQIPRLLGPGLNKAGKFPTLVSHQESLEGKVNETKAMVKFQLKKVLCMGVAVGNVSMDEKQIFQNVQLSVNFLVSLLKKNWQNVRCLYLKSSMGKSYRVF

SEQ ID NO: 5687 - protein, 216 aa, Cynara scolymus
  misc_feature (216)..(216): Xaa can be any naturally occurring amino acid
MSKLQSEALREAITQITTDAKEKKRNFTETIELQIGLKNYDPQKDKRFSGTVKLPHIPRPKLKVCMLGDAQHVEEAQKIGLEYMDVEGLKKLNKNKKLVKKLAKKHQAFLASESVIKQIPRLLGPGLNKAGKFPTLVTHQESLEAKVNETKATVKFQLKKVLCMGVAVGNCSMEDKQIFQNVQMSVNFLVSLLKKNWQNVRCLYLKTTMGKPGRIX

SEQ ID NO: 5688 - protein, 211 aa, Lotus japonicus
MSKLQNDAVREAISGIMTDSKEKNRKFVETIELQIGLKNYDPQKDKRFSGSVKLPHIPRPKMKICMLGDAQHVEEAEKIGLESMDVEALKKLNKNKKLVKKLAKKYHAFLASEAVIKQIPRLLGPGKFPTLVTHQESLESKVNETKAMVKFQLKKVLCMGVAVGNVSMEEKQIFQNVQLSVNFLVSLLKKNWQNVRCLYLKSTMGKSYRVF

SEQ ID NO: 5689 - protein, 216 aa, Medicago truncatula
MSKLQSDAVREAITGIMGDSKEKNRKFVETIELQIGLKNYDPQKDKRFSGSVKLPHIPRPKMKICMLGDAQHVEEAEKIGLESMDVEALKKLNKNKKLVKKLAKKYHAFLASEAVIKQIPRLLGPGLNKAGKFPTLVSHQESLEAKVNETKAMVKFQLKKVLCMGVAVGNVSMDEKQIFQNVQLSVNFLVSLLKKNWQNVRCLYLKSSMGKSYRVF

SEQ ID NO: 5690 - protein, 215 aa, Parthenium argentatum
MSKLQSEALREAITQITTDAKEKKRNFTETIELQIGLKNYDPQKDKRFSGTVKLPHIPRPKLKVCMLGDAQHVEEAQKIGLEYMDVESLKKLNKNKKLVKKLAKKHQAFLASESVIKQIPRLLGPGLNKAGKFPTLVSHQESLEAKVNETKATVKFQLKKVLCMGVAVGNCSMEEKQIFQNVQMSVNFLVSLLKKNWQNVRCLYLKTTMGKPVRI

SEQ ID NO: 5691 - protein, 216 aa, Rosa hybrid cultivar
MSKLQSDTLREAISIIMAASKEKSRKFTETIELQIGLKNYDPQKDKRFSGSVKLPHIPRPKMKVCMLGDAQHVEEAQKIGLEYMDVEALKKLNKNKKLVKKLAKKYHAFLASEAVIKQIPRLLGPGLNKAGKFPTLVSHQESLESKISETKATIKFQLKKVLCMGVAVGNVSMEEKQIFQNVQLSVNFLVSLLKKNWQNVKCLNLKTTMGKPYRIY

SEQ ID NO: 5692 - protein, 205 aa, Sequoia sempervirens
AITGLVGESKEKNRKFVETIELQIGLKNYDPQKDKRFSGSVKLPHIPRPKMKLCMLGDAQHVEEAVKIGLDYMDVEGLKKMNKNKKLVKKLAKKYHAFLASEAIIKQIPRLLGPGLNKAGKFPTLVSHQESLEGKVNETKATIKFQLKKVLCMGVAVGNCGMEEKQIFQNVQLSVNFLVSLLKKNWQNVRCLYLKSTMGKPSRIF

SEQ ID NO: 5693 - protein, 216 aa, Fragaria vesca
MSKLQSEALREAISQIKTNAETKKRKFTETVELQIGLKNYDPQKDKRFSGSVRLPHIPRPKMRVCMLGDAQHVEEAEKMGLAYMDVESLKKLNKNKKLVKKLAKKYHAFLASEAVIKQIPRLLGPGLNKAGKFPTLVSHQESLEAKLNETKAMVKFQLKKVLCMGVAVGNLAMEEKQIFQNVQLSVNFLVSLLKKNWQNVRSLNLKSTMGKAIRIY

SEQ ID NO: 5694 - protein, 216 aa, Unknown
  Sequence found in Organisms: Euphorbia peplus, Euphorbia esula
MSKLQSEALREAITTIMTASKEKKRNFTETIELQIGLKNYDPQKDKRFSGSVKLPHIPRPKMKVCMLGDAQHVEEATAIGLQWMDVEALKKLNKNKKLVKKLAKQYHAFLASESVIKQIPRLLGPGLNKAGKFPTLVTHQESLESKVNETKATVKFQLKKVLCMGVAVGNCAMEEKQVFQNVQMSVNFLVSLLKKNWQNVKCLNLKTTMGSPQRVF

SEQ ID NO: 5695 - protein, 216 aa, Fagopyrum esculentum
MSKLSNDALREAISTISKSAAEKPKKFTETIELQIGLKNYDPQKDKRFSGSVKLPHVPRPKMKVCMLGDAQHVEESEKVGLDSMDVEALKKLNKNKKLVKKLAKKYHAFLASEAVIKQIPRLLGPGLNKAGKFPTLVSHQESLENKVQEIKSTVKFQLKKVLCMGVAVGNCGMEEKQIFQNVQMSVNFLVSLLKKNWQNVRCLYLKSTMGRPVRIF

SEQ ID NO: 5696 - protein, 212 aa, Flaveria ramosissima
MSKLQSDALREAITQITTDAKEKKRNFTETIELQIGLKNYDPQKDKRFSGTVKLPHIPRPKLKVCMLGDAQHVEEAQKIGLEYMDVEGLKKLNKNKKLVKKLAKKHQAFLASESVIKQIPRLLGPGLNKAGKFPTLVTHQESLEAKVNETKATVKFQLKKVLCMGVAVGNCSMEEKQIFQNVQMSVNFLVSLLKKNWQNVRCLYLKTTMGKP

SEQ ID NO: 5697 - protein, 216 aa, Rosa hybrid cultivar
MSKLQSEALREAISQIKTNSETKKRKFTETVELQIGLKNYDPQKDKRFSGSVKLPHIPRPKMRVCMLGDAQHVEEAEKMGLAYMDVESLKKLNKNKKLVKKLAKKYHAFLASEAVIKQIPRLLGPGLNKAGKFPTLVSHQESLEAKLNETKAMVKFQLKKVLCMGVAVGNLAMDEKQIFQNVQLSVNFLVSLLKKNWQNVRSLNLKSTMGKAIRIY

SEQ ID NO: 5698 - protein, 216 aa, Helianthus annuus
MSKLQSEALREAITQITTDAKEKKRNFTETIELQIGLKNYDPQKDKRFSGTVKLPHIPRPKLKVCMLGDAQHVEEAQKIGLEYMDVEGLKKLNKNKKLVKKLAKKHQAFLASESVIKQIPRLLGPGLNKAGKFPTLVSHQESLEAKVNETKATVKFQLKKVLCMGVAVGNCSMEEKQIFQNVQMSVNFLGSLVKKNWQNVRCLYLKTTMGKPVRIF

SEQ ID NO: 5699 - protein, 210 aa, Brassica rapa
MSKLQSEAVREAISSMITHCKETKPRKFTETIELQIGLKNYDPQKDKRFSGSVKLPHIPRPKMKICMLGDAQHVEEAEKIGLDSMDVEALKKLNKNKKLVKKLAKKFHAFLASESVIKQIPRLLGPGLNKAGKFPTLVSHQESLEAKVNETKATVKFQLKKVLCMGVAVGNLGMEEKQIFQNVQMSVNFLVSLLKKNWQNVRCLYLKSTM

SEQ ID NO: 5700 - protein, 210 aa, Catharanthus roseus
MSKLQSDALREAISQIKNDADAKKRNFTETVELQIGLKNYDPQKDKRFSGSVRLPHIPRPKMKVCMLGDAQHVEEAEKIGLEYMDVEGLKKLNKNKKLVKKLAKKYHAFLASEAVIKQIPRLLGPGLNKAGKFPTLVTHQESLESKVNETKATVKFQLKKVLCMGVAVGNCAMEEKQIFQNVQMSVNFLVSLLKKNWQNVRCLYLGRDHA

SEQ ID NO: 5701 - protein, 216 aa, Hevea brasiliensis
MSKLQSEALREAISTIMTASKEKKRNFTETIELQIGLKNYDPQKDKRFSGSVKLPHIPRPKMKICMLGDAQHVEEAEGIGLQWMDVEALKKLNKNKKLVKKLAKQYHAFLASESVIKQIPRLLGPGLNKAGKFPTLVTHQESLESKVNETKATVKFQLKKVLCMGVAVGNCAMEEKQVFQNVQMSVNFLVSLLKKNWQNVKCLHLKTTMGAPQRIF

SEQ ID NO: 5702 - protein, 216 aa, Mesembryanthemum crystallinum
MSKLQSDAVREAISGIQNDAREKNRKFTETIELQIGLKNYDPQKDKRFSGTVKLPNIPRPKMKVCMLGDAQHVEEAERIGLEWMDVEALKKLNKNKKLVKKLAKKYHAFLASESVIKQIPRLLGPGLNKAGKFPALVTHQEPLENKVNEAKATVKFQLKKVLCMGVAVGNCGMDDKQIFQNVQMSVNFLVSLLKKNWQNVRCLYLKSTMGQPYRIF

SEQ ID NO: 5703 - protein, 216 aa, Jatropha curcas
MSKLQSETLREAISTIMAASVEKKRNFTETIELQIGLKNYDPQKDKRFSGSVKLPHIPRPKMKICMLGDAQHVEEAEAIGLQWMDVEALKKLNKNKKLVKKLAKQYHAFLASESVIKQIPRLLGPGLNKAGKFPTLVTHQESLESKVNETKATVKFQLKKVLCMGVAVGNCAMEEKQVFQNVQMSVNFLVSLLKKNWQNVKCLNVKTTMGNPVRIF

SEQ ID NO: 5704 - protein, 216 aa, Pisum sativum
MSKLQSEAVREAISGIMGDSKDKQRKFVETIELQIGLKNYDPQKDKRFSGSVKLPHIPRPKMKICMLGDAQHVEEAEKIGLESMDVEALKKLNKNKKLVKKLAKRYHAFLASEAVIKQIPRLLGPGLNKAGKFPTLVSHQESLEAKVNETKAMVKFQLKKVLCMGVAVGNVSMDEKQIFQNVQLSVNFLVSLLKKNWQNVRCLYLKSSMGKSYRVF

SEQ ID NO: 5705 - protein, 216 aa, Triphysaria pusilla
MSKVSPDAIREAIATIATESKEKNRKFTETIELQIGLKNYDPQKDKRFSGSVKLPHIPRPKMQICMLGDAQHADEAEKIGLASMDVEALKKLNKNKKLVKKLAKKYHAFLASEAVIKQIPRLLGPGLNKAGKFPTLVSHQESLEGKVNETKATIKFQLKKVLCMGVAVGNLGMEEKQIFQNVQMSINFLVSLLKKNWQNVRCLYLKSTMGKPQRIF

SEQ ID NO: 5706 - protein, 204 aa, Ambrosia trifida
MSKLQSEALREAITQITTDAKEKKRNFTETIELQIGLKNYDPQKDKRFSGTVKLPHIPRPKLKVCMLGDAQHVEEAQKIGLEYMDVESLKKLNKNKKLVKKLAKKHQAFLASESVIKQIPRLLGPGLNKAGKFPTLVSHQESLEAKVNETKATVKFQLKKVLCMGVAVGNCSMEEKQIFQNVQMSVNFLVSLLKKNWQMCGACT

SEQ ID NO: 5707 - protein, 89 aa, Flaveria ramosissima
MSKLQSDALREAITQITTDAKEKKRNFTETIELQIGLKNYDPQKDKRFSGTVKLPHIPRPKLKVCMLGDAQHVEEAQKKLVLNIWMLRG

SEQ ID NO: 5708 - protein, 587 aa, Manihot esculenta
MNILFFLLFTTAFSFLRFVCSSPADHSYNVGDPVPLFVNKVGPLHNPSETYRYYDLPFCRPDNVIRKKETLGEVLNGDRLSSALYDLKFREDKTGVTLCKKKLKGDEVLRFRDAIIDDFYFQMYYDDLPLWGFIGKVEEQSWIVGQREFKYYLFKHVQFDVLYRGNRVIEVSAFSDPNHAVDITEDVDIDVEFTYSVIWNATSAPFETRMDKYSRASFHPVHQQIHWFSFVNSIIIILLLMGLLTGLFMRRLRNDLKKCSGGDEEEDKEVGWKYIHSDVFRYPHNISLFSAVLGTGTQLLTMVCFLFVLAFVGVLYPYNRGALCTSFVLVYTLTSVVGGYTTAAFHNQFAQTGWKRSVIFTGILFLGPLFVILSILNIIAVSYGTTATLPFGTIMVILLIHVFFTVPLLALGGLLGYCFRSVFQAPSATKRYPREIPPLGWYRKTPAQMFLAGILCCSAIILELHHLYASLWGYKICTLPSILFVTFIILILLTALLSIVMTYILLSAEDHQWWWRSVLCGGAPAIFMFSYGICFFARSNMRGFMQLSFFLGYNACICYAFFLMLGTVSFRASFMFVSHIYHAVKSE

SEQ ID NO: 5709 - protein, 85 aa, Gerbera hybrid cultivar
MSKLQSEALREAITQITTDAKEKKRNFTETIELQIGLKNYDPQKDKRFSGTVKLPHIPRPKLKVCMLGDAQHVEEAQKKALNYGR

SEQ ID NO: 5710 - protein, 102 aa, Ipomoea nil
MSKLQSDAVREAITQIMGDSKEKNRKFTETIELQIGLKNYDPQKDKRFSGSVKLPHIPRPKMKICMLGDAQHVEEAEKIGMEYMDVEFKETQQEQETCKEAG

SEQ ID NO: 5711 - protein, 80 aa, Lotus japonicus
MSKLQNDAVREAISGIMTDSKEKNRKFVETIELQIGLKNYDRQKDKRFSGSVKLPHIPRPKMKICMLGDAQHVEEAEKLD

SEQ ID NO: 5712 - protein, 112 aa, Cajanus cajan
MSKLQSDALREAISGIMADSKEKNRKFVETIELQIGLKTMIPKRTSVLSGSVKLPHIPRPKMKICMLGDAQHVEEAEKIGLDYMDVEALKKLNKNMKLVKKLAKKYHAFFGF

SEQ ID NO: 5713 - protein, 204 aa, Camellia sinensis
MSKLQSDALREAITQITNDAKEKKRNFTETVELQIGLKNYDPQKDKRFSGSVKLPHIPRPKMKVCMLGDAQHVEEAEKIGLEYMDVEGLKKLNKNKKLVKKLAKKYHAFLASEAVIKQIPRLLGPGLNKAGKFPTLVTHQESLESKVNETKATVKFQLKKVLCMGVAVGNLSMEEKQIFQNVQMSVNFLVSLLKKNWQNVSACT

SEQ ID NO: 5714 - protein, 152 aa, Ambrosia trifida
MLGDAQHVEEAQKIGLEYMDVESLKKLNKNKKLVKKLAKKHQAFLASESVIKQIPRLLGPGLNKAGKFPTLVSHQESLEAKVNETKATVKFQLKKVLCMGVAVGNCSMEEKQIFQNVQMSVNFLVSLLKKNWQNVRCLYLKTTMGKRRSHYV

SEQ ID NO: 5715 - protein, 191 aa, Citrus sinensis
MLRRRERETSRRPLLFQRKKLKKGTTTRFNWVGGNTKDKSEIENSKLSSEVLREAVSTICGDAKEKNRNFVETIELQIGLKNYDPQKDKRFSGSVKLPHIPRPMMKVCMLGDAQHVEQAEKIGMDYMDVEALKKLNKNKKLVKKLAKKYHAFLASEAVIKQIPRLLGPGLNKAGKEVPNTGDSSRVPGSKS

SEQ ID NO: 5716 - protein, 151 aa, Ambrosia trifida
MLGDAQHVEEAQKIGLEYMDVESLKKLNKNKKLVKKLAKKHQAFLASESVIKQIPRLLGPGLNKAGKFPTLVSHQESLEAKVNETKATVKFQLKKVLCMGVAVGNCSMEEKQIFQNVQMSVNFLVSLLKKNWQNVRCLYLKTTMGKPIRIF

SEQ ID NO: 5717 - protein, 216 aa, Malus domestica
MSKLSSDGLREAISQIKTNSETKKRKFTETVELQIGLKNYDPQKDKRFSGSVRLPHIPRPKMRVCMLGDAQHVEEAEKMGLDYMDVESLKKLNKNKKLVKKLAKKYHAFLASEAVIKQIPRLLGPGLNKAGKFPTLVSHQESLEAKLNETKAMVKFQLKKVLCMGVAVGNLAMEEKQIFQNVQLSVNFLVSLLKKNWQNVRSLNLKSTMGKAIRIY

SEQ ID NO: 5718 - protein, 216 aa, Malus domestica
MSKLQSDTLREGISIIMTASKEKKRNFTETIELQIGLKNYDPQKDKRFSGSVRLPHIPRPKMKVCMLGDAQHVEEAEKIGLDYMDVEGLKKLNKNKKLVKKLAKKYHAFLASEAVIKQIPRLLGPGLNKAGKFPTLVSHQESLESKVSETKAMIKFQLKKVLCMGVAVGNVSMEEKQVFQNVQLSVNFLVSLLKKNWQNVRCLHLKTTMGKPYRIY

SEQ ID NO: 5719 - protein, 99 aa, Fagus grandifolia
MSKLQSDTLREAISTLFVGSNDKKRNFTETIELQIGLKNYDPQKDKRFSGSVKLPHIPRPKMKVCMLGDAQHVEEAEKMGLDYMDVEALKKLKQKQEIG

SEQ ID NO: 5720 - protein, 206 aa, Cephalotaxus harringtonia
EAITTVVGDSKEKPKKFVETIELQIGLKNYDPQKDKRFSGSVKLPHIPRPKMKLCMLGDAQHVEEAVKIGLDYMDVEGLKKMNKNKKLVKKLAKKYHAFLASEAIIKQIPRLLGPGLNKAGKFPTLVSHQESLEGKVNETKATIKFQLKKVLCMGVAVGNCGMEEKQIFQNVQLSVNFLVSLLKKNWQNVRCLYLKSTMGKPSRIF

SEQ ID NO: 5721 - protein, 114 aa, Fagopyrum esculentum
MSKLSNDALREAISTISKAAQEKPKKFTETIELQIGLKNYDPQKDKRFSGSVKLPHVPRPKMKVCMLGDAQHVEESEKVGLDSMDVEALKKLNKNKKLVKKLAKKYHAFWHPKL

SEQ ID NO: 5722 - protein, 213 aa, Flaveria ramosissima
LQSDALREAITQITTDAKEKKRNFTETIELQIGLKNYDPQKDKRFSGTVKLPHIPRPKLKVCMLGDAQHVEEAQKIGLEYMDVEGLKKLNKNKKLVKKLAKKHQAFLASESVIKQIPRLLGPGLNKAGKFPTLVTHQESLEAKVNETKATVKFQLKKVLCMGVAVGNCSMEEKQIFQNVQMSVNFLVSLLKKNWQNVRCLYLKTTMGKPVRIF

SEQ ID NO: 5723 - protein, 216 aa, Linum usitatissimum
MSKLQSETLREAISAIKAAANEKPRKFTETVELQIGLKNYDPQKDKRFSGSVKLPHIPRPKMKVCMLGDAQHVEEANAMGLQSMDVESLKKLNKNKKLVKKLAKSYHAFLASESVIKQIPRLLGPGLNKAGKFPTLVSHQESLESKVNEIKATVKFQLKKVLCMGVAVGNLDMDEKQIFQNVQMSINFLVSLLKKNWQNVKVLNLKSTMGKPQSIF

SEQ ID NO: 5724 - protein, 198 aa, Fraxinus spp
MSRRRSVTCLRQLSSRLGLKNYDPQKDKRFSGSVKLPHIPRPKMKICMLGDAQHVEEAEKIGLESMDVEALKKLNKNKKLVKKLAKRYHAFLASEAVIKQIPRLLGPGLNKAGKFPTLVSHQESLESKVNETKATVKFQLKKVLCMGVAVGNCAMEEKQIFQNVQMSVNFLVSLLKKNWQNVRCLYLKSTMGKPQRIF

SEQ ID NO: 5725 - protein, 216 aa, Silene vulgaris
MSKLSSEAVREAIAGISSDAKEKGRKFTETIELQIGLKNYDPQKDKRFSGSVKLPHVPRPKMKVCMLGDAQHVEEAERIGMESMDVEALKKLNKNKKLVKKLAKKYHSFLASESVIKQIPRLLGPGLNKAGKFPTLVSHQEPLENKVNETKATIKFQLKKVLCMGVAVGNCSMDEKQIFQNVQMSVNFLVSLLKKNWQNVRCLYLKSTMGRPYRIF

SEQ ID NO: 5726 - protein, 216 aa, Helianthus annuus
MSKLQSEALREAITQITTDAKEKKRNFTETIELQIGLKNYDPQKDKRFSGTVKLPHIPRPKLKVCMLGDAQHGEEAQKIGLEYMDIEGLKKLNKNKKLVKKLAKKHQAFLASESVIKQIPRLLGPGLNKAGKFPTLVSHQESLEAKVNETKATVKFQLKKVLCMGVAVGNCSMEEKQIFQNVQMSVNFLVSLLKKNWQNVRCLYLKTTMGKPVRIL

SEQ ID NO: 5727 - protein, 216 aa, Ceratodon purpureus
MSKLQSDVLREAISQITTAAKEKNRKFTETVELQIGLKNYDPQKDKRFSGSVKLPHIPRPKMKVCMLGDAQHVEEANKIGMECMDVESLKKMNKNKKLVKKMAKKYHAFLASESVIKQIPRLLGPGLNKAGKFPALVSHQESLEAKMMETKAMVKFQLKKVLCMGVAIGNCEMEEKQIFQNTQMSVNFLVSLLKKNWQNVRVLYLKTTMGAPVRIY

SEQ ID NO: 5728 - protein, 308 aa, Mesembryanthemum crystallinum
  misc_feature (217)..(217): Xaa can be any naturally occurring amino acid
  misc_feature (223)..(223): Xaa can be any naturally occurring amino acid
  misc_feature (228)..(228): Xaa can be any naturally occurring amino acid
  misc_feature (250)..(250): Xaa can be any naturally occurring amino acid
  misc_feature (252)..(252): Xaa can be any naturally occurring amino acid
  misc_feature (256)..(256): Xaa can be any naturally occurring amino acid
  misc_feature (258)..(258): Xaa can be any naturally occurring amino acid
  misc_feature (260)..(260): Xaa can be any naturally occurring amino acid
  misc_feature (264)..(264): Xaa can be any naturally occurring amino acid
  misc_feature (268)..(268): Xaa can be any naturally occurring amino acid
  misc_feature (279)..(280): Xaa can be any naturally occurring amino acid
  misc_feature (282)..(285): Xaa can be any naturally occurring amino acid
  misc_feature (290)..(290): Xaa can be any naturally occurring amino acid
  misc_feature (292)..(292): Xaa can be any naturally occurring amino acid
  misc_feature (296)..(296): Xaa can be any naturally occurring amino acid
MSKLQSDAVREAISSIYNDSKEKQRKFTETMELQIGLKNYDPQKDKRFSGSVRLPHIPRPKMKVCILGDAQHVEEAEKIGIESMDVEALKKLNKNKKLVKKLAKKYHAFLASEAVIKQIPRLLGPGLNKAGKFPTLVTHQESLETKVNETKAMVKFQLKKVLCMGVAIGNLAMEEKQVFQNVQMGVNFLVSLLKKNWQNVRCLYLKSSMGKPYRIYXACSVSXNGKAXVCNILKKLGEERYSMQGYSYGXWXFLDXNXDXVGKXIYLXMYLLFVENLVXXVXXXXYQFAXNXQVEXSGASLIWLNHPV

SEQ ID NO: 5729 - protein, 216 aa, Quercus alba
MSKLQSDTLREAISTLFAGSRDKKRNFTETIELQIGLKNYDPQKDKRFSGSVKLPHIPRPKMKVCMLGDAQHVEEAEKMGLDYMDVEALKKLNKNKKLVKKLAKKYHAFLASESVIKLIPRLLGPGLNKAGKFPTLVTHQESIDSKVNETKAMVKFQLKKVLCMGVAVGNVAMEEKQVFQNVQMSVNFLVSLLKKNWQNVRSLSLKTTMGRPVRVY

SEQ ID NO: 5730 - protein, 216 aa, Physcomitrella patens
MSKLQSDVLREAITQITTAAKEKNRKFTETVELQIGLKNYDPQKDKRFSGSVKLPHIPRPKMRVCMLGDAQHVEEANKIGMEYMDVESLKKMNKNKKLVKKLAKKYHAFLASESVIKQIPRLLGPGLNKAGKFPTLVSHQESLESKGQELKAMVKFQLKKVLCMGVAIGNCDMEEKQIFQNTQMGVNFLVSLLKKNWQNVRVLYLKTTMGTPVRIY

SEQ ID NO: 5731 - protein, 217 aa, Artemisia annua
MSKLSSEALREAITSITTDAKEKKVRNFTETIELQIGLKNYDPQKDKRFSGTVRLPHIPRPKLKVCMLGDAQHVEEAQKIGLEYMDVESLKKLNKNKKLVKKLAKKHQAFLASESVIKQIPRLLGPGLNKAGKFPTLVSHQESLEAKVNETKATVKFQLKKVLCMGVAVGNCSMEEKQIFQNVQMSVNFLVSLLKKNWQNVRCLYLKTTMGKPVRIF

SEQ ID NO: 5732 - protein, 183 aa, Guizotia abyssinica
MSKLQSDALREAITQITTDAKEKKRNFTETIELQIGLKNYDPQKDKRFSGTVKLPHIPRPKLKVCMLGDAQHVEEAQKIGLEYMDVESLKKLNKNKKLVKKLAKKHQAFLASESVIKQIPRLLGPGLNKAGKFPTLVSHQESLEAKVNETKATVKFQLKKVLCMGVAVGNCSMEEKQIFQTFK

SEQ ID NO: 5733 - protein, 60 aa, Pinus taeda
MASGNSWADQWDNTNNNEEYNNNSESYGRKEKGNGKMAKVKVVAVSGLEKAKVVATVGRN

SEQ ID NO: 5734 - protein, 216 aa, Linum usitatissimum
MSKLQSESLREAISTIKTAAQEKPRKFTETIELQIGLKNYDPQKDKRFSGSVKLPHIPRPKMKVCMLGDAQHVEEANAMGLQSMDVESLKKLNKNKKLVKKLAKQYHAFLASESVIKQIPRLLGPGLNKAGKFPTLVSHQESLESKVNEIKATVKFQLKKVLCMGVAVGNLDMDEKQIFQNVQMSINFLVSLLKKNWQNVKVLNLKSTMGKPVQIF

SEQ ID NO: 5735 - protein, 216 aa, Linum usitatissimum
MSKLQSESLREAISTIKTAAQVKPRKFTETVELQIGLKNYDPQKDKRFSGSVKLPHIPRPKMKVCMLGDAQHVEEANAMGLQSMDVESLKKLNKNKKLVKKLAKQYHAFLASESVIKQIPRLLGPGLNKAGKFPTLVSHQESLESKVNEIKATVKFQLKKVLCMGVAVGNLDMDEKQIFQNVQMSINFLVSLLKKNWQNVKVLNLKSTMGKPVQIF

SEQ ID NO: 5736 - protein, 216 aa, Ocimum basilicum
MSKLQSEALREAISVIKNDSAEKKRKFSETIELQIGLKNYDPQKDKRFSGSVRLPHIPRPKMKICMLGDAQHVGEAEKIGLEYMDVESLKKLNKNKKLVKKLAKKYHAFLASESVIKQIPRLLGPGLNKAGKFPTLVSHQESLESKVNETKATIKFQMKKVLCMGVAVGNCDMEEKQIFQNVQMSVNFLISLPKKNWQNVRCLFLKSPMGKTQRVF

SEQ ID NO: 5737 - protein, 216 aa, Castanea mollissima
MSKLQSDTLREAISTLFTGSKDKKRNFTETIELQIGLKNYDPQKDKRFSGSVKLPHIPRPKMKVCMLGDAQHVEEAEKMGLDYMDVEALKKLNKNKKLVKKLAKKYHAFLASESVIKLIPRLLGPGLNKAGKFPTLVTHQESIDSKVNETKAMVKFQLKKVLCMGVAVGNVAMEEKQVFQNVQMSVNFLVSLLKKNWQNVRSLSLKTTMGRPVRVY

SEQ ID NO: 5738 - protein, 216 aa, Prunus persica
MSKLSSDGLREAIAQIKTNSETKKRNFTETVELQIGLKNYDPQKDKRFSGSVRLPHIPRPKMRVCMLGDAQHVEEAEKMGLDYMDVESLKKLNKNKKLVKKLAKKYHAFLASEAVIKQIPRLLGPGLNKAGKFPTLVSHQESLEAKVNETKAMVKFQLKKVLCMGVAVGNLAMEEKQIFQNVQLSVNFLVSLLKKNWQNVRSLNLKSTMGKAIRIY

SEQ ID NO: 5739 - protein, 216 aa, Linum usitatissimum
MSKLQSDSLRDAITTIKTAAQEKPRKFTETVELQIGLKNYDPQKDKRFSGSVKLPHIPRPKMKVCMLGDAQHVEEANAMGLQSMDVESLKKLNKNKKLVKKLAKQYHAFLASESVIKQIPRLLGPGLNKAGKFPTLVSHQESLESKVNEIKATVKFQLKKVLCMGVAVGNLDMDEKQIFQNVQMSINFLVSLLKKNWQNVKVLNLKSTMGKPVQIF

SEQ ID NO: 5740 - protein, 213 aa, Euphorbia peplus
LQSEALREAITTIMTASKEKKRNFTETIELQIGLKNYDPQKDKRFSGSVKLPHIPRPKMKVCMLGDAQHVEEATAIGLQWMDVEALKKLNKNKKLVKKLAKQYHAFLASESVIKQIPRLLGPGLNKAGKFPTLVTHQESLESKVNETKATVKFQLKKVLCMGVAVGNCAMEEKQVFQNVQMSVNFLVSLLKKNWQNVKCLNLKTTMGSPQRVF

SEQ ID NO: 5741 - protein, 216 aa, Linum usitatissimum
MSKLQSDSLREAITTIKTAAQEKPRKFTETVELQIGLKNYDPQKDKRFSGSVKLPHIPRPKMKVCMLGDAQHVEEANAMGLQSMDVESLKKLNKNKKLVKKLAKQYHAFLASESVIKQIPRLLGPGLNKAGKFPTLVSHQESLESKVNEIKATVKFQLKKVLCMGVAVGNLDMDEKQIFQNVQMSINFLVSLLKKNWQNVKVLNLKSTMGKPVQIF

SEQ ID NO: 5742 - protein, 210 aa, Amborella trichopoda
  misc_feature (198)..(198): Xaa can be any naturally occurring amino acid
  misc_feature (201)..(201): Xaa can be any naturally occurring amino acid
  misc_feature (203)..(203): Xaa can be any naturally occurring amino acid
MSKLQSDTLREVIGKVMGDAKKKNRKFTETIELQIGLKNYDPQKDKRFSGSVKLPHVPRPKMKVCMLGDAQHVEEAEKMGLDYMDVEGLKKLNKNKKLVKKLAKKYHAFLASEAVIKQIPRLLGPGLNKAGKFPTLVSHQESLESKVNETKAIVKFQLKKVLCMGVAVGNCAMEEKQVFQNVQMSVNFLVSLLKKNWXNVXSXYLKSTMG

SEQ ID NO: 5743 - protein, 199 aa, Musa acuminata
MSKLQSDVLREAISQVVGDSREKKRKFTETVELQIGLKNYDPQKDKRFSGSVKLPHIPRPKMKVCMLGDAQHVEEAEKIGLDYMDVESLKKMNKNKKLVKKLAKKYHAFLASEAIIKQIPRLLGPGLNKAGKFPTLVTHQESLESKVNETKAMVKFQLKKVLCMGVAVGNCAMEEKQIFQNVQLSVNFLVSLLKRTGKM

SEQ ID NO: 5744 - protein, 202 aa, Adiantum capillus-veneris
MSKLQSDVLREAITQLVSESKEKKRKFVETVELQIGLKNYDPQKDKRFSGSVKLAHIPRPKMKVCMLGDAQHVEEAEKIGLDCMDVDALKKMNKNKKLVKKLAKKYHAFLASEAVIKQIPRLLGPGLNKAGKFPTLVSHQESLEGKLNETKATVKFQLKKVLCMGVAVGNLEMEEKQLFQNVQLSVNFLVSLLKKNWQNVRV

SEQ ID NO: 5745 - protein, 216 aa, Physcomitrella patens
MSKLQSDVLREAITQITTAAKEKNRKFTETVELQIGLKNYDPQKDKRFSGSVKLPHIPRPKMRVCMLGDAQHVEEANKMGMEYMDVESLKKMNKNKKLVKKLAKKYHAFLASESVIKQIPRLLGPGLNKAGKFPTLVSHQESLDAKCQETKAMVKFQLKKVLCMGVAIGNCDMEEKQIFQNTQMGVNFLVSLLKKNWQNVRVLYLKTTMGTPVRIY

SEQ ID NO: 5746 - protein, 112 aa, Linum usitatissimum
MSKLQSDSLREAITTIKTAAQEKPRKFTETVELQIGLKNYDPQKDKRFSGSVKLPHIPRPKMKVCMLGDAQHVEEANAMGLQSMDVESLKKLNKNKKLVKKLAKQYHAFFGF

SEQ ID NO: 5747 - protein, 238 aa, Oryza sativa
MSKLQSDALREAISQITSESREKQRKFVETIELQIGLKNYDPQKDKRFSGSVKLPHIPRPKMKVCMLGDAQHVEEAEKMGLDYMDVEALKKMNKNKKLVKKLAKKYHAFLASEAIIKQIPRLLGPGLNKAGKILLVYGRSILKSSYIIVSKRGKFPTLVTHQESLESKVNETKATVKFQLKKVLCMGVAVGNCAMEEKQIFQNVQMSVNFLVSLLKKNWQNVRCLYLKSTMGKVIRVF

SEQ ID NO: 5748 - protein, 210 aa, Sarracenia psittacina
MQSGRLSPKLLEMQKKKRRNFVETIELQIGLKNYDPQKDKRFSGSVKLPHIPRPKMKVCMLGDAQHVEEAEKIGLDYMDVEGLKKLNKNKKLVKKLAKKYHAFLASEAVIKQIPRLLGPGLNKAGKFPTLVSHQESLESKVNETKATVKFQLKKVLCMGVAVGNCGMEDKQIFQNVQMSVNFLVSLLKKNWQNVRCLYLKSTMGRPVRIF

SEQ ID NO: 5749 - protein, 184 aa, Artemisia annua
MSKLSSDALREAITQITTDAKEKKVRNFVETIELQIGLKNYDPQKDKRFSGTVRLPHIPRPKLKVCMLGDAQHVEEAQKIGLEYMDVESLKKLNKNKKLVKKLAKKHQAFLASESVIKQIPRLLGPGLNKAGKFPTLVSHQESLEAKVNETKATVKFQLRRFFAWVSLLETAAWRRNRSSKMCK

SEQ ID NO: 5750 - protein, 147 aa, Triticum aestivum
MSKLQSESVKDAISQIVGDAKEKNRKFTETVELQIGLKNYDPQKDKRFSGSVKLPHIPRPKMKVCMLGDAQHVEEAEKMGLDYMDVEALKKMNKNKKLVKRLAKKYHAFLGIRGHHQADSPSPWSWVSTRQASSRPWLLTRNPSSPR

SEQ ID NO: 5751 - protein, 194 aa, Brassica rapa
KPRKFTETIELQIGLKNYDPQKDKRFSGSVKLPHIPRPKMKICMLGDAQHVEEAEKIGLESMDVEALKKLNKNKKLVKKLAKKFHAFLASESVIKQIPRLLGPGLNKAGKFPTLVSHQESLEAKVNETKATVKFQLKKVLCMGVAVGNLDMEEKQIFQNVQMSVNFLVSLLKKNWQNVRCLYLKSTMGPPNRVF

SEQ ID NO: 5752 - protein, 216 aa, Physcomitrella patens
MSKLQSDVLREAITQIVAAAKEKNRKFTETVELQIGLKNYDPQKDKRFSGSVKLPHIPRPKMRICMLGDAQHIEEATKNGIECMDVESLKKMNKNKKLVKKLAKKYHAFLASESVIKQIPRLLGPGLNKAGKFPALVSHQESLESKVLESKAMVKFQLKKVLCMGVAIGNCGMEEKQIFQNTQMGVNFLVSLLKKNWQNVRVLYLKTTMGAPVRIY

SEQ ID NO: 5753 - protein, 260 aa, Citrus clementina
MLRRRERETSRRPLLFQRKKLKKGTTTRFNWVGGNTKDKSEIENSKLSSEVLREAVSTICGDAKEKNRNFVETIELQIGLKNYDPQKDKRFSGSVKLPHIPRPMMKVCMLGDAQHVEQAEKIGMDYMDVEALKKLNKNKKLVKKLAKKYHAFLASEAVIKQIPRLLGPGSTRQARKFPTLVTHQESLEAKVNETKAVVKFQLKKVLCMGVAVGNCSMEEKQVFQNVQLSVNFHVSLLKKNWQNVRCLHLKSTMGRPQRIC

SEQ ID NO: 5754 - protein, 194 aa, Zingiber officinale
KKRNFTETIELQIGLKNYDPQKDKRFSRSVKLPHIPRPKMKVCMLGDAQHIEEAEKIGLDYMDVESLKKMNKNKKLVKKLAKKYHAFLASEAIIKQIPRLLGPGLNKAGKFPTLVSHQETLESKVNETKAMVKFQLKKVLCMGVAVGNVAMEEKQIFQNVQMSVNLLVSLLKKNWQNVRCLYLKSTMGKPYRIF

SEQ ID NO: 5755 - protein, 206 aa, Parthenium argentatum
MSKLQSEALREAITQITTDAKEKKRNFTETIELQIGLKNYDPQKDKRFSGTVKLPHIPRPKLKVCMLGDAQHVEEAQKIGLEYMDVESLKKLNKNKKLVKKLAKKHQAFLASESVIKQIPRLLGPGLNKAGKFPTLVSHQESLEAKVNETKATVKFQLKKVLCMGVAVGNCSMEEKQIFQNVQMSVNFLVSLLKKNWQNVRCLYLK

SEQ ID NO: 5756 - protein, 208 aa, Euphorbia peplus
LREAITTIMTASKEKKRNFTETIELQIGLKNYDPQKDKRFSGSVKLPHIPRPKMKVCMLGDAQHVEEATAIGLQWMDVEALKKLNKNKKLVKKLAKQYHAFLASESVIKQIPRLLGPGLNKAGKFPTLVTHQESLESKVNETKATVKFQLKKVLCMGVAVGNCAMEEKQVFQNVQMSVNFLVSLLKKNWQNVKCLNLKTTMGSPQRVF

SEQ ID NO: 5757 - protein, 216 aa, Silene vulgaris
MSKLSSDAVREAISGILTDAKDKERKFVQTIELQIGLKNYDPQKDKRFSGSVKLPHVPRPKMKVCMLGDAQHVEEAERVGLESMDVEALKKLNKNKKLVKKLAKKYHSFLASESVIKQIPRLLGPGLNKAGKFPTLVTHQEPLENKVNEIKATIKFQLKKVLCMGVAVGNCGMDEKQIFQNVQMSVNFLVSLLKKNWQNVRCLYLKSTMGRPYRIF

SEQ ID NO: 5758 - protein, 200 aa, Medicago truncatula
MADSKEKNRKFVETIELQIGLKNYDPQKDKRFSGSVKLPHIPRPKMKICMLGDAQHVEEAEKIGLESMDVEALKKLNKNKKLVKKLAKKYHAFLASEAVIKQIPRLLGPGLNKAGKFPTLVSHQESLEAKVNETKAMVKFQLKKVLCMGVAVGNVSMDEKQIFQNVQLSVNFLVSLLKKNWQNVRCLYLKSSMGKSYRVF

SEQ ID NO: 5759 - protein, 186 aa, Eragrostis curvula
MSKLQTEVLNDGIANVVKDAKEKNRKFTETIELQIGLKNYDPQKDKRFSGSVKLPHIPRPKMKVCMLGDAQHVEEAGKMGLDYMDVESLKKMNKNKKLVKKIAKKYHAFLASEAIIKQIPRLLGPGLNKAGKFPKLVSHQESLESKVHETKPGPVPAEERSLHWCCCGQLVHGRRRRIQSNVQIER

SEQ ID NO: 5760 - protein, 94 aa, Citrullus lanatus
MSKLQSDALREAISSIFADTSEKKRNFTETIELQIGLKNYDPQKDKRFSGSVKLPHIPRPKMKICMLGDASHVEEAENGLDYMDVEGLKKLNKN

SEQ ID NO: 5761 - protein, 191 aa, Brassica juncea
KFTETIELQIGLKNYDPQKDKRFSGSVKLPHIPRPKMKICMLGDAQHVEEAEKIGLESMDVEALKKLNKNKKLVKKLAKKFHAFLASESVIKQIPRLLGPGLNKAGKFPTLVSHQESLEAKVNETKATVKFQLKKVLCMGVAVGNLGMEEKQIFQNVQMSVNFLVSLLKKNWQNVRCLYLKSTMSPPTRVF

SEQ ID NO: 5762 - protein, 196 aa, Eschscholzia californica
MSKLQSEVLREAITQISGDAKEKARKFTETVELQIGLKNYDPQKDKRFSGSVKLPHIPRPKMKVCMLGDAQHVEEAEKIGLDYMDVEGLKKLNKNKKLVKKLAKRFHAFLASEAVIKQIPRLLGPGLNKAGKFPTLVSHQESLEAKVNETKAMVKFQLKKVLCMGVAVGNLGMEEKQIFQNVQLSVNFLVSLLKKN

SEQ ID NO: 5763 - protein, 216 aa, Populus trichocarpa
MSKLAGDTIREAVTTIKNGVNEKPRKFTQTIELQIGLKNYDPQKDKRFSGSVKLPHIPRPKMKVCMLGDAQHVEEAVSIGLQWMDVEALKKLNKNKKLVKKLSKQYHAFLASESVIKQIPRLLGPGLNKAGKFPTLVTHQESLESKVNEIKATVKFQLKKVLCMGVAVGNCDMEDKQIFQNVQMSVNFLVSLLKKNWQNVKSLHLKSTMGTPVRLY

SEQ ID NO: 5764 - protein, 194 aa, Flaveria ramosissima
KKRNFTETIELQIGLKNYDPQKDKRFSGTVKLPHIPRPKLKVCMLGDAQHVEEAQKIGLEYMDVEGLKKLNKNKKLVKKLAKKHQAFLASESVIKQIPRLLGPGLNKAGKFPTLVTHQESLEAKVNETKATVKFQLKKVLCMGVAVGNCSMEEKQIFQNVQMSVNFLVSLLKKNWQNVRCLYLKTTMGKPVRIF

SEQ ID NO: 5765 - protein, 199 aa, Brassica oleracea
MSKLQSEVLREGITAVKGKADEKKRNFVETVELQIGLKNYDPQKDKRFSGSVKLPHIPRPKMKICMLGDAQHVEEAEKIGLDYMDVEALKKLNKNKKLVKKLAKKYHAFLASESVIKQIPRLLGPGLNKAGKFPTLVSHQESLEGKVNETKATVKFQLKKVLCMGVAVGNLSMEEKQLFQNVQMSVNFLVSLLKKIGKT

SEQ ID NO: 5766 - protein, 216 aa, Populus trichocarpa
MSKLAGDTIREAVTTIKNGVNEKPRKFVQTIELQIGLKNYDPQKDKRFSGSVKLPHIPRPKMKVCMLGDAQHVEEATSIGLQWMDVEALKKLNKNKKLVKKLSKQYHAFLASESVIKQIPRLLGPGLNKAGKFPTLVTHQESLESKVNEIKATVKFQLKKVLCMGVAVGNCDMEDKQIFQNVQMSVNFLVSLLKKNWQNVKSLHLKSTMGTPVRLY

SEQ ID NO: 5767 - protein, 540 aa, Sorghum bicolor
MRMKTLACCRRRPQDFSIDMDKEPDRVMTYNGLETCIINSSAYDDDSAISATTGGDGCVTTDSLDDEVSSCSSKDASGSSFSSHCLSKQDEHSLDELGTPIAIHLLPFKGKKPITYTLSASDIENMKEKFAKLLLGDDTSGGARGVCAALALSNGIINLSATVFGELWKLEPLCEDKKIRWRKEMDWLLSPTTYMVELVPTKQSGADGCTFEIMTPKARSDVHVNLPALQKLDAMLIEVMDSMIDTEFWYEESGSRADGRGKITGPRKSKKWWLPSPRVPEEGLSQFQRKRLVFQAKLVHQILKAAKSINEQVLFHMPIPAAVMDALPKSGRASLGEDLYQAITTQYIPIEEIFVSLSLKTEHSVLETINRLEGAVFAWNQRILEERSKRSPGRHSWSFMKDSSSELDKMSACIERVDTLVQLLKSRYPNLPPTFIDVLKVQYNVDVGHAIVEAYSRVLVGVAFSILSRVAEILLEDDLIKKPNTPMATLKFDLSSDVYLAGITETPPGHIRRSLMDQISMVDGRFDAVVKKKGVKQLRW

SEQ ID NO: 5768 - protein, 334 aa, Sorghum bicolor
MRMKTLACCRRRPQDFSIDMDKEPDRVMTYNGLETCIINSSAYDDDSAISATTGGDGCVTTDSLDDEVSSCSSKDASGSSFSSHCLSKQDEHSLDELGTPIAIHLLPFKGKKPITYTLSASDIENMKEKFAKLLLGDDTSGGARGVCAALALSNGIINLSATVFGELWKLEPLCEDKKIRWRKEMDWLLSPTTYMVELVPTKQSGADGCTFEIMTPKARSDVHVNLPALQKLDAMLIEVMDSMIDTEFWYEESGSRADGRGKITGPRKSKKWWLPSPRVPEEGLSQFQRKRLVFQAKLVHQILKAAKSINEQVLFHMPIPAAVMDALPKAIWES

SEQ ID NO: 5769 - protein, 541 aa, Zea mays
MRMKTLACCRRRPQDFSIDMDQEPDRVVTYNGLETCIINSSTYDDDSGISATTGGDGCITTDSLDDEVSSCSSKDASGSSFTSHSLSKQEEHSLDELGTPMAIHLLPFKGKKTITYTLSASDIENMKEKFAKLLLGDDTSGGARGVCVALALSNGIINLSATVFGELWKLEPLCEDKKIRWRKEMDWLLSPTTYMVELVPTKQSGADGCTFEIMTPKARSDVHVNLPALQKLDMMLIEVMDSMIDTEFWYEESGSRADGRGKITGPRKSKKWWLPSPRVPEQGLSQFQRKRLVFQAKLVHQILKAAKSINEQVLSHMPIPAAVMDALPKSGRASLGEDLYQAITTDYIPVEEIFVSLSLKTEHSVLETINRLEGAVFAWNQRILEERSKRSPGRHSWSFMKDSSSEVDKMSACIERVDALVQLLKSRYPNLPPTFIDVLKVQYNVDVGHAIVEAYARVLVGVAFSILSRVAEILLEDDLIKKPNTPMTTLKFDLSSDVYLAGITETPPGHIRRSLMDQISMVDGRYDAVVGKKKEVKQLRW

SEQ ID NO: 5770 - protein, 356 aa, Pennisetum glaucum
MDWLLSPTTYMVELVPTKQSGADGCTFEIMTPKARSDVHVNLPALQKLDAMLIEVMDSMIDTEFWYEESGSRADGGKSSGPRKSKKWWLPSPRVPEQGLSQLQRKRLVFQAKLVHQILKAAKSINEQVLFHMPIPAAVMDALPKSGRTSLGEDLYQAITTEYIPIEEIFISLSLKTEHSVLETINRLEGAVFAWNERISEEKSKRSPGRHSWKFMKDGSSELDKMSVCIERVDTLVQLLKSRFPNLPPTFIDVLKVQYNMDVGHAIVEAYSRALVGVAFSILSRVAEILLEDDLIKKPNTPMATLKFDLSSDVYLAGITETPPGHIRRSLMDQISMVDGRFDAVVAKKKGVKQLRW

SEQ ID NO: 5771 - protein, 318 aa, Panicum virgatum
  misc_feature (192)..(192): Xaa can be any naturally occurring amino acid
DFSIDMDQEPDRVMTYNGLETCIINSSAYDDDSGVSATTGGDGCVTNDSLDDEVSSCSSKDASGSSFSSNCLSKQEEHSLDELGTPIAVHLLPFKGKEPITYTLSASDIENMKEKFAKLLLGDDTSGGARGVCTALALSNGIINLSATVFGELWKLEPLCEEKKIRWRKEMDWLLSPTTYMVELVPTKQSGXDGCTFEIMTPKARSDVHVNLPALQKLDAMLIEVMDSMIDTEFWYEESGSRADGRGKITGLRKSKKWWLPSPRVPEQGLSQFQRKRLVFQAKLVHQILKAENHQRTSPIPYAYSCSCYGCPPKVWES

SEQ ID NO: 5772 - protein, 540 aa, Zea mays
MKMKALACCRRRPQDLSIDMDQEPDRVMTYNGLETCIINCSAYDDDSGISATTCGDGCVTADSLDDEVSSCFSKDASGSSFSSHCLSKQEEHSLDELGTPIAIHLLPFKAKKPITYTLSASDIENMKKKFAKLLLGYDTSGGARGVCAALALSNGIINLSATVFGELWKLEPLCEDKKIRWRKEMDWLMSPTTYIVELVPRKQSGADGCTFEIMTPKARSDVHVNLPALQKLDTMLIEVMDSMIDTEFWYEESGSRADGPVKITGPRKSKKWWLPSPRVPEQGLSRFQRKRLVFQAKLVHQILKAAKSINEQVLFHMPIPAAVMDALPKSGRASLGEDLYQAITTEYIPIEEIFVSLSLKTEHSVLETMNQLEGAMFAWNQRILEERSKRSPGRHSWSFMKDSSSELDKMSACIERVDTLVQLLKARYPNLPPTFIDVLKVQYNVDVGNAIVEAYSRVLVGVAFSILSRVAEILLEDDLVKRPNTPMASLKFDLSSDVYLAGITETPPGHVRRSLMDQISMVDGRFNAAVKKKGAKQLRW

SEQ ID NO: 5773 - protein, 543 aa, Oryza sativa
MRMKTLACCRRRPQDFSIDMDQEPDRVMTYNGLESCIINSSSYDDDSGLSATTGADGCVTTDSVDDEVSSCSSSKDVSSSSFSSQCHPLRKQEEHSLYELDTLSAVHLLPLKGKKPITYTLSASDIETMKEKFGKLLLGDDASGGARGVCAALALSNAIINLSATIFGELWKLEPLCEEKKVRWRKEMDWLLSPTTYMVELVPTKQNGADGCTFEIMTPKARSDVNVNLPALQKLDSMLIEVLDSMVDTEYWYVESGSRANGRGKKNGLRQTKKWWLPSPRVPDIGLSQFQRNRLVFQAKLVHQILKAAMSINEEVLLQIPIPPAVTDALPKSGRAGLGEDLYHAITTEYIPIEEIFLSLSLKTEHTVLETMNRLEGAVFAWNQRISEEKSKKSPGRHSWNFMKDSSSELDKMSMCIERVETLMQLLKSRFPSLPPTFIEVVKIQYNVDVGHAIVEAYSRVLVGVAFSILSRVAEILLEDDLIKKPNTPLATLKFDLSSDVYLAGITETPPGHIRRSLMDQISLVDGSLDAVVRKKGVKQLRW

SEQ ID NO: 5774 - protein, 543 aa, Secale cereale
MRMKTLACCRRRPQDFSIDMDQEPEKVTTYNGLESCIFNSSSYDEDSGVSATTGADGCVTADSLEDEASSCSSSKDVDGSSFSSQCLPLSKQEEHSLYELDTLDAIHLLPVKGKNPITYTLSAADIETMKEKFAKLLLGDDVSGGARGVCAALALSNGITNLSATIFGELWKLEPLCEEKKIRWRKEMDWLLSPTTYMVELVPTKQNGADGCMFEIMTPKARSDVHVNLPALQKLDSMLIEILDSMVDTEYWYVESGSRSGGRSKTNGERQTKKWWLPSPCVPEQGLSQFQRKRIVFQAKLVHQILKAAKSINEQVLLQIPIPMAVMDALPKSGRSSLGEDLYHAITTDYIPIEEIFVSLSLKTEHSVLETMNRLEGALFAWNQRISEERSRRSPARHSWKFMKDSSSELEKMSACIERVETLIQLLKCRFPNLPPTFIDVVKVQYNEDVGHAIVEAYSRVLVGVAFSILSRVAEIMLEDDLIKKPNTPMATLKFDLSSDVYLAGITETPPGHIRRSLMDQISMVDGRFDAVVKKKGAKQLMW

SEQ ID NO: 5775 - protein, 543 aa, Hordeum vulgare
MRMKTLACCRRRPQDFSVDMDQEPEKVTTYNGLESCIFNSSSYDEESGVSATTGADGCVTADSLEDEVSSCSSSKDVDGSSFSSQCLPLSKQEEHSLYELDTLDAIHLLPVKGKNPITYTLSAADIETMKEKFAKLLLGDDVSGGARGVCAALALSNGITNLSATIFGELWKLEPLCEEKKIRWRKEMDWLLSPTTYMVELVPTKQNGADGCMFEIMTPKARSDVHVNLPALQKLDSMLIEVLDSMVDTEYWYVESGSRSGGRGKNNGQRQTKKWWLPSPCVPEQGLSQFQRKRIVFQAKLVHQILKAAKSINEQVLHQIPIPMAVMDALPKSGRSSLGEDLYHAITTDYIPIEEIFVSLSLKTEHSVLETMNRLEGALFAWNQRISEEKCKRSPGRHSWNFMKDNSSELEKMSACIERVETLIQLLKSRFPNLPPTFIDVVKVQYNEDVGHGIVEAYSRVLVGVAFSILSRVAEIMLEDDLIKKPNTPMATLKFDLSSDVYLEGITETPPGHIRRSLMDQISMVDGRFDAVVKKRGAKQLMW

SEQ ID NO: 5776 - protein, 543 aa, Brachypodium distachyon
MRMKTLACCRRRPQDFSIDMDQEPDRVTTYNGLERCIFNSSSYDEDSGISATTGVDGCVTTDSLDDEVSSCSSSKDVDGSSFSSQYISSSKQEEHSVYGLDTLDTVHQLPVKGKNPIRYTLSASDIETMKEKFAKLLLGDDISGGARGVCAALALSNGITNLSATIFGELWKLEPLCEEKKIRWRKEMDWLLSPTTYMVELVPTKQNGADGCIFEIMTPKARSDVHVNLPALQKLDSMLIEVLDSMVDTEYWYVESGSRAGDRGKNNGPRQTKKWWLPSPCVPEQGLSQFQRKRIIFQAKLVHQILKAAKSINEQVLLQIPIPTAVMGALPKSGRASLGEDLYHAITTDYIPIEDIFISLSLKTEHSVLETMNRLEGALFAWNQRISEERSKKSPGRHSWNFMKDSSSEVEKMTACIERVETLMQLLKSRFPNLPPTFTDVVKVQYNEDVGHAIVEAYSRVLVGVSFSILSRIAEVMLEDDLIKKPNTPMATLKFDLSSDVYLAGITETPPGHIRRSLMDQISMVDGRFDTVVKKKGAKQLMW

SEQ ID NO: 5777 - protein, 313 aa, Panicum virgatum
MASTTTCCLSLLVLVALASVASAQLSSTFYDTSCPRALATIKSAVNAAVAKEARMGASLLRLHFHDCFVQGCDASILLAGNEQNDPPNLTLRGFDVIANIKAQVEAICKQTVSCADILAVAARDSVVALGGPSWSVPLGRRDSPKAASTSTVNQFLIPPTASLAELIKGYGDLGLNPTDMVALSGAHTIGQAHCPSYQDHIYNDTNINQAFATSLRASCPMTGGSNVMAPLDTATPTAFDNAYFKNLLSQKGLLHSDQELFNGGSTDNIVRNFASSPSAFSSAFVTAMVKMGNLSPLTGTQGQIRTTCSAANS

SEQ ID NO: 5778 - protein, 291 aa, Panicum virgatum
MASTTTCCLSLLVLVALASAASAQLSSTFYDTSCPRALATIKSAVNAAVAKEARMGASLLRLHFHDCFVQGCDASILLAGNEQKDPPNLTLRGFTVIDSIKAQVEAICKQTVSCADILAVAARDSVVALGGPSWSVPLGRRDSPTAASTTTVLQFLIPPTASLGELITGYGNLGLNPTDMVALSGAHTIGQAHCPSYQDHIYNDTNINQAFATSLRASCPMTGGARHGAAGHGDAHRVRQCLLQEPDGAEGASALGPGALQRRQHRQHCPELRVQPVGLQQRLRDGHGEDG

SEQ ID NO: 5779 - protein, 153 aa, Panicum virgatum
MDWLPGELCLKIFQLLDHQSLASAPQVCRKWRALTSDDELWRKLFTDRWGPDAAAFYAPEGSKPWKDVFVVQDRCDRYGLGVRIIREGKDYYLIYQGEIQRYLGSRQDTDGDGGKDAPRQDADDDEQRQIANRILFFLGDLEAACADAKRVKA

SEQ ID NO: 5780 - protein, 155 aa, Pennisetum glaucum
MDWLPGELCLKIFHLLDHQSLASAPQVCRKWRALTSDDELWRKLFSDRWGADAAAFYAPAGTKSWKDVFVVQDRCDRYGLGVRIIREGKDYYLIYQGEIQRYLGSRQDTDGDGGGKDTAPQDAEAEDKQRQISNRIIFFLGDLEAACADAKRVKA

SEQ ID NO: 5781 - protein, 154 aa, Sorghum bicolor
MDGLPRELCLKIFHLLDHQSLASAPQVCRKWSALTSDGELWRKLFNDRWGADAAAFYAPEGDKSWKDVFVVQDRCDRYGLGVRIIREGKDYYLIYQGEIQRYLGSRQDTDTDGDCGKDAPRQDAGDEHRQISNRILFFLGDLEKACADAKRVKA

SEQ ID NO: 5782 - protein, 154 aa, Saccharum officinarum
MDGLPRELCLKIFHLLDHQSLASAPQVCRKWSALTSDDELWRKLFNDRWGADAAAFYAPESSKSWKDVFVVQDRCDRYGLGVRIIREGKDYYLIYQGEIQRYLGSRQDTDTDGDCGKNAPRQDAGDEHRQISNRILFFLGDLEKACADAKRVKA

SEQ ID NO: 5783 - protein, 152 aa, Zea mays
MDGLPRELCLKIFHLLDHQSLASSPQVCRKWRALTSDDELWRKLFNDRWGADAAAFYAPEGSKSWKDVFAVQDRCDRYGLGVRIIREGKDYYLIYQGEIQRYLGSRQDTDGDCGEDAPRRDAGDEHRQISDRILFFLGDLEKACADAKRVKA

SEQ ID NO: 5784 - protein, 1184 aa, Sorghum bicolor
MYGICAQRSDGKVLNCANATKAVKPDTLFSSRIQSLCPTITGDVCCTVDQFDTLHQQVQQAVPFLVGCPACLRNFLNLFCEMSCSPNQSLFINVTSVKQVHFCLFFSQINSTMTVDGLDYYVTTNYGEELYDSCKDVKFGTLNTRAMDFIGAGAKTYKDWLAFIGRQANSNEPGSPYLITFRSDFSDSSGVKPLNSTIYSCGDPSLGCSCGDCPSSSECTGSLLPQLNTETSCSVKMGSLKAKCLDFSLVVIYLALLCAFLLWGLLHRTRGRTAFGQTRPLRNSDNKSDSNKNGKSPHNSVQVPEAASSTVKPSNPSIVQAYMSIFFRKHGIFVARHPLLVLCVSLLVPVLLCIGLFRFKVETRPEKLWVSPGSQAADEKNYFDSHLAPFYRIEQLVLATSASGGSEAPSIVNDNNMKLLFDVQKKVDDLRVNYSGSTVALADICLKPLSTDCATQSVLQYFQLDPKKFDDSGIDHAKFCFQHYTSEETCLSTFQSPIDPSTILGGFLGSNFTEASAFVITYPVNNKVETTGKENGKAVAWERAFINLVKLANPALIFQLGYLRICHPSRIREEIRPMVLAQNLTLSFSSESSIQDELNRESTADAITIVISYIVMFAYISFTLGDRPSRWLLLFVSSKVLLGLSGVVLVMLSVLGSMGFFSAIGVKSTLIIMEVIPFLVLARFSLTLSMSTNNSEYLDFSEQINKANSTAISPSYFIHIAVVTTLCLFYWKALAVFMDFLLQVTAFVALIVFDFRRAQDGRIDCVPCARIMPSTGAGDGGDEQRLHLLARYMRDIHGPILSYRAVKFVVVTVFLGLTFASIDYFDDLAKYMKVGPPLYFVVKDFNYSSASVHTNQICSINQCNSNSLLNEISRQSLSPETSYIAKPAASWLDDFLVWMSPEAFGCCRKFVNGNYCPPDDQCFLHSDLDNGRPSTTQFRDKLPWFLDALPSSDCSKGGKGAYSTSLDLSGYESGIIQASAFRTYHTPLNKQSDYVNSMRAARDFSSKMSKDLQMNIFPYSVFYIFFEQYLSVWKTAIMNICVCLGTIFVVCFIVTGSLWASAIILIVLAMIVLDLMGVMAILGIQLNAIAVVNLVMSIGIAVEFCVHITHAFMIGAGDRETRARQALSTMGASVFSGITLTKLVGVIVLRFAKSEVFVVYYFQMYLALVIIGFLHGLIFLPVRI

SEQ ID NO: 5785 - protein, 840 aa, Panicum virgatum
LSGSVVVGAQGGLPIEAGRRRSVPFLLHGLLSSAPRPAPRCGCAACAAEAADTLQQGKSLSAAETLVSTPEGVFEAGFFPPDPKQPSRLYLGIWYRGIAPRTVVWVANRAAPATSAAPSLALTDTGELQVLDGAASNGTAAPPLLWSSNTSWAAPRGGYYASLLDSGSLQVRSDDGALSWDSFWHPTDTILSGMQIAVRAPGPPGRGASNERMLFTSWASETDPAPGRYALGLDPAGSGQAYMWRDGKDIYWRSGQWNGVNFIGIPWRPLYLSGFSLSSDRDLGLHYTYTATNTSLQRFVVLPNGTDICYMVKNSTKEWETVWLQPSNVCEYYAACGPNAKCTVGQDGKAKCTCLKGFQPKLWDQWNAGNWSEGCTRNPPLGCQVNQPGDGFLPIGNIKWPDFSYWMSTVADETGCKNACLNNCSCGAYVHTTTTGCLVWGDKLIDLHELPTGAYTLNLKLPASELRVHHAVWRIATIISAVVLFVLLACLVLWWKRGRNIKDAVHRSWRSRQSSTWSQQNSAMLDISQSIRFDDEVEDGKSHELKVYSLDRIKAATSNFSDSNKLGEGGFGPVYMGTLPGGEEVAVKRLCRNSGQGLEEFKNEVILIAKLQHRNLVRLLGCCIQREEKILVYEYMPNKSLDAFLFNPEKQGLLDWSKRFDIIEGIARGLLYLHRDSRLRVVHRDLKASNILLDADMNPKISDFGMARMFGGDQNQFNTNRVVGTFGYMSPEYAMEGIFSVKSDVYSFGVLILEIITGKRAVSFHYHQDSMNIAGYAWRQWNEDKATELIDPLIRASCSVRQVLRCIHIALLCVQDHADERPDIPTVIIMLSSDSSSLPN

SEQ ID NO: 5786 - protein, 864 aa, Sorghum bicolor
MVGMKPGGGVLRFSSTMAPSPPRLLFPLLASLCCAVAAQTTDTLRQGQSLSGAATLVSSPEGVFELGFFAPDTNQPSRQYLGIWYHGISPRTVVWVANRVAPATSALPSLALTVTGELRVLDGTTANGTADAPLLWSSNATSRAAPRGGYSAVLHDSGNLEVRSEDDGVLWDSFSHPTDTILSGMRITLQTPGRGPKERMLFTSWASETDPSPGRYALGLDPNAQAYIWKDGNVTYWRSGQWNGVNFIGIPWRPLYLSGFTPSNDPALGGKYYTYTATNTSLQRFVVLPNGTDICYMVKKSSQEWETVWYQPSNECEYYATCGPNSLCTALQDGKAKCTCLKGFRPKLQEQWNAGNWSQGCIRSPPLGCEANQSGDGFLPMRNIKWPDLSYWVSTVADETGCRTDCLNNCSCGAYVYTSTTGCLAWGNELIDMHELPTGAYTLNLKLPASELRGHHPIWKIATIASAIVLFVLAACLLLWWKRGRNIKDAVHRSWRSRHSSSRSQQNSAMLDISQSIRFDDDVEDGKSHELKVYSLERIKAATSNFSDSNKLGEGGFGPVYMGTFPGGEEVAVKRLCRNSGQGLEEFKNEVILIAKLQHRNLVRLLGCCIQREEKILVYEYMPNKSLDAFLFNPEKQGLLDWKKRFDIIEGIARGLLYLHRDSRLRVVHRDLKASNILLDADMNPKISDFGMARIFGGDQNQFNTNRVVGTFGYMSPEYAMEGIFSVKSDVYGFGVLILEIITGKRAVSFHCHEDSLNIAGYAWRQWNEDKAAELIDPVIRASCSVRQVLRCIHIALLCVQDHADERPDIPTVILMLSNDSSSLPNPRPPTLMLRGREIESSKSSEKDRSHSIGTVSMTQLHGR

SEQ ID NO: 5787 - protein, 848 aa, Zea mays
MVSSPRLLFLLLAGASLCCVAAQKTDTLRQGESLSGAATLVSSPEGVFEAGFFAPDPKQPSRQYLGIWYHSISPRTVVWVANRVAPATSASPSLTLTVTGELRVLDGTAANGTADAPLLWSSNTTSRAGPRGGYSAVLQDTGSLEVRSEDGVLWDSFWHPTDTILSGMRITLQAPGRGPKERMLFTSWASETDPSPGRYALGLDPGNSGQAYIWKDGNVTYWRSGQWNGVNFIGIPWRPLYRSGFTPAIDPVLGNYYTYTATNTSLQRFVVLPNGTDICYMVRKSSQDWELVWYQPSNECEYYATCGPNAKCTASQDGKAKCTCLKGFHPKLQEQWNAGNWSQGCIRSPPLGCETNQSGDGFLPMGNIKWPDFSYWVSTVGDEPGCRTVCLNNCSCGAYVYTATTGCLAWGNELIDMHELQTGAYTLNLKLPASELRGHHPIWKIATIISAIVLFVLAACLLLWWKHGRNIKDAVHGSWRSRHSSTQSQQNSAMLDISQSIRFDDDVEDGKSHELKVYSLDRIRTATSNFSDSNKLGEGGFGPVYMGTLPGGEEVAVKRLCRNSGQGLEEFKNEVILIAKLQHRNLVRLLGCCIQREEKILVYEYMPNKSLDAFLFNPEKQRLLDWKKRFDIIEGIARGLLYLHRDSRLRVVHRDLKASNILLDADMKPKISDFGMARMFGGDQNQFNTNRVVGTFGYMSPEYAMEGIFSVKSDVYGFGVLILEIITGKRAVSFHCHEDSLNIAGYAWRQWNEDNAAELIDPVIRASCSVRQVLRCIHIALLCVQDHADERPDIPTVILMLSNDSSSLPNPRPPTLMLRGREIESSKSSEKDRSHSIGTVTMTQLHGR

SEQ ID NO: 5788 - protein, 340 aa, Pennisetum glaucum
MGSSQESTFSSASAAAQVNASALDLLPVYAKELIAGGAAGAFAKTAVAPLERVKILLQTRTEGFQSLGILQSLRKLWQYEGVRGFYKGNGASVLRIVPYAALHYMTYEQYRCWILSNFAPSVGTGPVVDLLAGSAAGGTAVLCTYPLDLARTKLAYQVSNVGPSGNALGNSGRQQTYNGIKDVFKTVYKEGGARSLYRGVGPTLIGILPYAGLKFYIYEDLKSRVPDDYKKSVILKLSCGALAGLFGQTLTYPLDVVRRQMQVQSKQPQNSSDGFRIRGTFQGLMLIIRCQGWRQLFAGLSLNYVKVVPSVAIGFTTYDMMKALLGVPPRERIHASGGNK

SEQ ID NO: 5789 - protein, 340 aa, Saccharum officinarum
MGSSQESTFSSASAAAQVNASALDLLPVYAKELIAGGAAGAFAKTAVAPLERVKILLQTRTEGFQSLGILQSLRKLWQYEGIRGFYKGNGASVLRIVPYAALHYMTYEQYRCWILNNFAPSIGTGPVVDLLAGSAAGGTAVLCTYPLDLARTKLAYQVSNVGQPGNAFGNSGQQQTYNGIKDVFKTVYKEGGARSLYRGVGPTLIGILPYAGLKFYIYEDLKSQVPEDYKNSVILKLSCGALAGLFGQTLTYPLDVVRRQMQVQSKQPQNSSDGFRIRGTFQGLLLIIRCQGWRQLFAGLSLNYVKVVPSVAIGFTTYDMMKTLLGVPPRERVHASGGNK

SEQ ID NO: 5790 - protein, 340 aa, Sorghum bicolor
MGSSQESTFSSASAAAQVNASALDLLPVYAKELIAGGAAGAFAKTAVAPLERVKILLQTRTEGFQSLGILQSLRKLWQYEGIRGFYKGNGASVLRIVPYAALHYMTYEQYRCWILNNFAPSIGTGPVVDLLAGSAAGGTAVLCTYPLDLARTKLAYQVSNVGQPGNAFGNSGQQQTYNGIKDVFKTVYKEGGARSLYRGVGPTLIGILPYAGLKFYIYEDLKSQVPEDYKNSVILKLSCGALAGLFGQTLTYPLDVVRRQMQVQSKQPQNSSDGFRIRGTFQGLLLIIHCQGWRQLFAGLSLNYVKVVPSVAIGFTTYDMMKTLLGVPPRERVHASGGNK

SEQ ID NO: 5791 - protein, 336 aa, Panicum virgatum
QESTFSSASAAAQVDASALDLLPVYAKELIAGGAAGAFAKTAVAPLERVKILLQTRTEGFQSLGILQSLRKLWQYEGVRGFYKGNGASVLRIVPYAALHYMTYEQYRCWILNNFASSVGTGPVVDLFAGSAAGGTAVLCTYPLDLARTKLAYQVSNVGQSGNALGNSGQQQTYNGIKDVFKTVYKEGGARSLYRGVGPTLIGILPYAGLKFYIYEDLKSRVPEDYKKSVILKLSCGALAGLFGQTLTYPLDVVRRQMQVQSKQPQNSSDGFRIRGTFQGLSLIIRCQGWRQLFAGLSLNYVKVVPSVAIGFTTYDMMKALLGVPPRERVHASGASK

SEQ ID NO: 5792 - protein, 340 aa, Zea mays
MSSSQESTFTSASAAAQVNASALDLLPVYAKELIAGGAAGAFAKTAVAPLERVKILLQTRTEGFQSLGILQSLRKLWQYEGIRGFYKGNGASVLRIVPYAALHYMTYEQYRCWILNNSASSIGTGPVVDLLAGSAAGGTAVLCTYPLDLARTKLAYQVSNVGQTGNALGNSGQQQTYNGIKDVFKTVYKEGGARSLYRGVGPTLIGILPYAGLKFYIYEDLKSQVPDDYKDSVILKLSCGALAGLFGQTLTYPLDVVRRQMQVQSKQSQNSSDGFRIRGTFQGLLLIIRCQGWRQLFAGLSLNYVKVVPSVAIGFTTYDMMKALLGVPPRERVHASGGNK

SEQ ID NO: 5793 - protein, 340 aa, Oryza sativa
MGSSQESTFSSASTAAQVNACALDLLPVYAKELIAGGAAGAFAKTAVAPLERVKILLQTRTHGFQSLGILQSLRKLWQYEGIRGFYKGNGASVLRIVPYAALHYMTYEQYRCWILNNFAPSVGTGPVVDLLAGSAAGGTAVLCTYPLDLARTKLAYQVSNVGQPGNALGNAGRQPAYGGIKDVFKTVYKEGGARALYRGVGPTLIGILPYAGLKFYIYEDLKSRVPEDYKRSVVLKLSCGALAGLFGQTLTYPLDVVRRQMQVQNKQPHNANDAFRIRGTFQGLALIIRCQGWRQLFAGLSLNYVKVVPSVAIGFTTYDMMKNLLRVPPRERLYQSSGNA

SEQ ID NO: 5794 - protein, 337 aa, Brachypodium distachyon
MGSSQESTFSSASTAAQVNALDLLPVYAKELIAGGAAGAFAKTAVAPLERVKILLQTRTEGFQSLGIVRSLRKLWQYEGIRGFYKGNGASVLRIVPYAALHYMTYEQYRCWILNNAPSVGTGPVVDLLAGSAAGGTAVLCTYPLDLARTKLAYQVSNVAQPGNSLGNSGHQPVYNGVKDVFKTVYKEGGARSLYRGIGPTLIGILPYAGLKFYIYEDLKSRVPEDYKRSVVLKLSCGALAGLFGQTLTYPLDVVRRQMQVQNKQPQNVNDTFRIRGTFQGLLLIIRCQGWRQLFAGLSLNYVKVVPSVAIGFTTYDMMKNLLGVPPRERAHPSAGNK

SEQ ID NO: 5795 - protein, 339 aa, Triticum aestivum
MGRSQEFTFSFALTAAQVNALGLLPVYAKELIAGGAAGAFAKTAVAPLERVKILLQTRTQGFQSLGIVQSLRKLWQYEGIRGFYKGNGASVLRIVPYAALHYMTYEQYRCWILNNAPSVGTGPVVDLFAGSAAGGTAVLCTYPLDLARTKLAYQVSNVAQPVNSLGNFGRQPVYNGVKDVFKTVYKEGGVRSLYRGIGPTLIGILPYAGLKFYIYEDLKSRVPEDYKRSVILKLSCGALAGLFGQTLTYPLDVVRRQMQVQNKQPQNANDAFRIRGTFQGLFLIIRCQGWRQLFAGLSLNYVKVVPSVAIGFTTYDMMKNLLGVPPREKAHPLTGNSNK

SEQ ID NO: 5796 - protein, 1172 aa, Setaria italica
ASPPTAMPATDTDERPLVELAASATTPTATPTASASAPAPFFPPPAAPGFSRAVRCNAPSSFPADGGGFGGAGQQQHAAAYPGNAISTTKYTAASFVPKSLFEQFRRAANCFFLVVACVSFSPLAPYRAVSVLLPLLVVVSAAMAKEAVEDWRRKQQDIEVNNRKVEVYDGTQSFHETEWKKLRVGDIVKVKKDEFFPADLLFLSSSYDDGICYVETMNLDGETNLKRKQALDVTMGLNDEQFFHSFKAFIRCEDPNEKLYSFLGTLYYNEQQYPLSPQQILLRDSKLRNTSYIYGTVIFTGHDTKVMQNAMEPPSKRSSVERRMDKIIYLLFAILFAIATFGSIVFGMKTKHEISPGNYAWYLRPDQANIFFDPNRASFAAFCHFLTSLMLYVTLVPISLYISIEIVKVLQSTFINQDQNMYCAESDKPARARTSNLNEELGQVHTILSDKTGTLTCNSMEFLKCSIAGVAYGNSPTEMETSYGEIAETTANYGHKNTTEFKRLVKGFNFTDGRLMNGRWAKECSRDSIEMFFRVLAVCHTAIPVADRNSAGMPYEAESPDEGALVTAAREFGFEFYHRTQTTISVHEYDPVFGGKVDRTYKLLNILEFSSARKRMSVIVRTEVGRLFLFCKGADSVIFERLSKDNGKACLSKTKCHINEYSEAGLRTLVLAYRELTEEQYVLWNQKYSAAKNSVHTDHDEAVEKASEDIEKDLVLLGATAVEDRLQSGVPECIHKLAQAGIKIWILTGDKLETAVNIGYSCNLLRKEMEEIFITLDNSSTSASEGCSGEGNRMAPYEEIDRKLLDARTKVFMRGTSTLFALIIDGNALTHALTSSLKNSFLDLAVNCASVLCCRISPKQKALVTRLVKIRTGKTTLAIGDGANDVGMLQEADIGVGISGAEGMQAVMASDFAIAQFRFLERLLLVHGHWCYRRIAAMICYFFFKNITFGITLFWFEAHAMFSAQPAYNDWFISFYNVAFTSLPVIALGVFDKDVSSRVCLEVPSLHQDGVNNVFFSWSRILSWMLNGLCCSIIIYFGSLNAILIQAVRQDGRVAGFDILGVTMYTCVVWTVNCQLALYISYFTWIQHFVIWGSILIWYAFLVIYGLFPPAISTTAYHVFLEACASSPLYWLSTLMIVVTALIPFFVYKISRTLYYPQYHDKVQRTNSKNW

SEQ ID NO: 5797 - protein, 1161 aa, Sorghum bicolor
MPMDTDERPLVELASASAGAAAAATTPTASTSASAPFPAPATPGFSRAVRCNAPASSLPGTDGGAQQPAYPGNAISTTKYTPASFVPKSLFEQFRRAANCFFLVVACVSFSPLAPYRAVSVLLPLVVVVSAAMAKEAVEDWRRKQQDIEVNNRKVEVFDGIQSFHETEWKKLRVGDIVKVKKDEFFPADLLFLSSSSDDGLCYVETMNLDGETNLKRKQALEVTMGLNDDQVFHSFKAFIRCEDPNEKLYSFLGTLYYNGQQYSLSPEQILLRDSKLRNTMCIYGTVIFTGHDTKVMQNAMEPPSKRSSVERRMDKIIYLLFVILFAIATFGSVVFGMKTKHEVSPGNYAWYLRPDQANIFFDPNNASFAAFCHFLTSLMLYVCLVPISLYISIEIVKVLQSTFINQDQNMYCAESDKPARARTSNLNEELGQVHTILSDKTGTLTCNSMEFLKCSIAGVAYGNMATEVVTCYGEIAETTGSFGHKDTAEFKRSVKGFNFTDSRLMNGRWAKECSRDAIEMFFRVLAVCHTAIPVADRNSAGMPYEAESPDEGALVTAAREFGFEFYHRTQTTISVHEYDPVVGGKVDRTYKLLNILEFSSARKRMSVIVRTEEGRLFLFCKGADSVIFERLSKDNGTACLTKTKCHIDEYSEAGLRTLALAYCELTEEQYVVWNQKYSSAKNSVHTDHDAAVEKASEDIEKDLVLLGATAVEDRLQNGVPECIYKLAQAGIKIWILTGDKLETAVNIGYACNLLRKEMEEIFITLENSGTNASEGSSGEGNKMAAFEEIDRKLQDARGKISQKGTSTSFALIIDGNALTHALTGRLKNSFLDLAVNCASVLCCRVSPKQKALVTRLIKIRTSKTTLAIGDGANDVGMLQEADIGVGISGAEGMQAVMASDFAIAQFRFLERLLLVHGHWCYRRIAAMICYFFFKNITFGFTLFWFEAHAMFSAQPAYNDWFISFYNVAFTSLPVIALGVFDKDVSSRVCLEVPSLHQDGVNNVFFSWSRILSWMLNGMCCSIIIYFGSLNAILVQAVRQDGRVAGFDILGVTMYSCVVWTVNCQLALYISYFTWIQHFVIWGSILIWYTFLVIYGLFSPAISTTAYHVFVEACAPSPLYWLSILMIVVTALIPFFVYKISRTLYYPQYHDQVQRANSKNW

SEQ ID NO: 5798 - protein, 1155 aa, Zea mays
MPMDTDERPLVELASAAAATTLAASSTSSAPFPAPATPGFSRAVRCNAPASSLPADGGAGAQPAYPENAISTTKYTPASFVPKSLFEQFRRAANCFFLVVACVSFSPLAPYRAVSVLLPLVVVVSAAMAKEAVEDWRRKQQDIEVNNRKVEVYDGIQSFHETEWKKLRVGDIIKVKKDEFFPADLIFLSSSSCDGLCYVETMNLDGETNLKRKQALEVTMGLNDDHFHSFKAFIRCEDPNEKLYSFLGTLYYNGQQYSLSPEQVLLRDSKLRNTMYIYGTIIFTGHDTKVMQNAMEPPSKRSSVERRMDKIIYLLFVILFVIATFGSIVFGMRTKHEISPGSYAWYLRPDQANIFFDPNNASFAAFCHFLTSLMLYVCLVPISLYISIEIVKVLQSTFINQDQNMYCAESDKPARARTSNLNEELGQVHTILSDKTGTLTCNSMEFLKCSIAGVAYGSRPTEVETCYGEIVETNGSFGRKDTTEFKRSVKGFNFTDSHLMNGRWAKECSRDAIEMFFRVLAVCHTAIPVADGNSAGMPYEAESPDEAALVTAAREFGFEFYHRTQTTISVHEYDPVVGGKVDRTYKLLNILEFSSARKRMSVIVRTEEGRLFLFCKGADSVIFERLSKDNGTAHLTKTKCHIDEYSEAGLRTLALAYCELTEEQYVVWNQDYSSAKNSVHTDHVAAVEKVSEDIEKDLVLLGATAVEDRLQNGVPECIYKLAQAGIKIWILTGDKLETAVNIGYACNLLRKEMEEIFITLENSSTSASEGSSGEGNKIATFEEIDRKLKDARGKISQKGTSTSFALIIDGNALTHALTGSLKNSFLDLAVNCASVLCCRVSPKQKALVTRLVKIRTSKTTLAIGDGANDVGMLQEADIGVGISGAEGMQAVMASDFAIAQFRFLERLLLVHGHWCYRRIAAMICYFFFKNITFGFTLFWFEAHAMFSAQPAYNDWFISFYNVAFTSLPVIALGVFDKDVSSHVCLEVPSLHQDGVNNVFFSWSRILSWMLNGMCCSIIIYFGSLNAILVQAVRQDGRVAGFDILGVTMYTCVVWTVNCQLALYISYFTWIQHFVIWGSILIWYTFLVIYGLFSPAISTTAYHVFVEACAPSPLYWLSTLMIVVTALIPFFVYKISRTLYYPQYHDQVQRANSKNW

SEQ ID NO: 5799 - protein, 1150 aa, Brachypodium distachyon
MRASATDTDERPLVELAVVTPTPSTSSPAALATGPPAPAPGFSRAVRCNAPSSASASGDGAYPGNAISTTKYTAASFLPKSLFEQFRRVANCFFLVVACVSFSPLAPYRAVSVLLPLFVVVSAAMAKEAVEDWRRKQQDIEVNNRKVEVYDGTQSFHETEWKKLRVGDIVKVKKDEFFPADLLLLSSCHEDGTCYVETMNLDGETNLKRKQSLDVTVGLSEEHSFHSFKAFIQCEDPNEKLYSFLGTLYYREQQYPLSPQQILLRDSKLRNTNFIYGTVIFTGHETKVMQNATEPPSKRSSVERRMDKIVYLLFAVLFTIASFGSIFFGIKTKAELNVGSYAWYLRPDQSSIFFDPNRASFAAFCHFLTSLMLYVCLVPISLYISIEMVKVLQSTFINQDQNMYCEESDKPARARTSNLNEELGQVHTILSDKTGTLTCNSMEFSKCSIAGVAYGSRLTEVEMSYGEIEDVSGQMHAAKSKRSVKGFNFTDGRLMNGEWAKECHRDAIEMFFRALAVCHTAIPVSDKDSIGMTYEAESPDEGALVAAAREFGFEFYHRTQTTISVHEYEPVFGKEVDRTYKLLNILEFSSARKRMSVILRTEEGRLFLFCKGADSVILERLSKDNEKSCVANTKQHIEVYSEAGLRTLALAYRELTEDDYAAWNEEYSSAKNSVHTDHDAAVEKASENIEKDLVLLGATAVEDRLQKGVPECIHKLAQAGIKIWILTGDKLETAVNIGYSCNLLRKEMEEFFVTLDNSGTNAPEGCNQEGSRMAPYEHIGRKLQDARRQISLKGTSTPFALIIDGNALTYALTGSLKDSFLDLAVDCASVLCCRMSPKQKALITRLVKTKTKKTTLAIGDGANDVGMLQEADIGVGISGAEGMQAVMASDFAIAQFRFLERLLLVHGHWCYRRIAAMICYFFFKNITFGFTLFWFEAHAMFSAQPGYNDWFISFYNVAFTSLPVIALGVFNKDVSASVCLEVPLLHQDGVNNVFFSWSRILSWMLNGLCSSIIIFFGAINAVLIQAVRQDGRVAGFDILGVTMYTCVVWTVNCQLALYISYFTWIQHFVIWGSILIWYTFLIIYGSFPAMISTTAYHVFWEACASSPLYWLSTLVIVVTALLPFFLYRVTCSLFNPQHPERVQRTNSKNW

SEQ ID NO: 5800 - protein, 1171 aa, Oryza sativa
MRPASASAADERPLVELTSAAATAPASTETSTFSSAPGFTRAVRCSGAGSSSSSSSSSDEGGGGVYPGNAISTTKYTAASFVPKSLFEQFRRAANCFFLVVACVSFSPLAPYRAVSVLLPLVVVVGAAMAKEAVEDWRRKQQDIEVNSRKVEVYDGTQSFHQTEWKKLQVGDIVKVKKDEFFPADLVLLSSSYEDGICYVETMNLDGETNLKRKQSLDVTAGLNEDHSFHTFKAFIQCEDPNEKLYSFLGTLHYNGQQYPLSPQQILLRDSKLRNTNQIYGIVIFTGHDTKVMQNAMEPPSKRSSVERRMDKIIYLLFVILFAIASFGSVMFGIRTRAELSAGNYAWYLRPDNSTMYFDPNRATLAAICHFLTSLMLYVCLVPISLYISIEIVKVLQSTFINQDQNMYCEESDKPARARTSNLNEELGQVHTILSDKTGTLTCNSMEFLKCSIAGVAYGNRPIEVQMPYGGIEEECVDIGQKGAVKSVRPVKGFNFTDDRLMNGQWSKECHQDVIEMFFRVLAVCHTAIPVADRTSGGMSYEAESPDEGALVAAARELGFEFYHRSQTSISVHEYDPVFGRKVDRTYKLLNTLEFSSARKRMSVIVSTEEGRLFLFCKGADSVILERLSKDNSKACLTNTKCHIDEYSEAGLRTLALAYRELTEDEYVAWNMEYSAAKNSVHNDHDVAVEKASENIEKDLVLLGATAVEDRLQKGVPECIHKLAQAGIKIWILTGDKLETAVNIGLVPYVAYVPDNYACNLLRKGMEEVYITLDNPGTNVPEEHNGESSGMAPYEQIGRKLEDARRQILQKGTSAPFALIIDGNALTHALMGGLKTAFLDLAVDCASVLCCRISPKQKALITRLVKNRIRKTTLAIGDGANDVGMLQEADIGVGISGAEGMQAVMASDFAIAQFRFLERLLLVHGHWCYRRIAAMICYFFFKNITFGFTLFWFEAHAMFSAQPGYNDWFISFYNVAFTSLPVIALGVFDKDVSSRVCLEVPSLHQDGVNNLFFSWSRILSWMLNGVCCSIIIYFGALHAVLIQAVRQDGHVAGFDILGVTMYTCVVWTVNCQLALYISYFTWIQHFVIWGSILIWYTFLVIYGSFPPTISTSAYHVFWEACASSPLYWLSTLVIVVTALIPYFLYKITQSLFCPQHCDQVQRPNSKELVAQ

SEQ ID NO: 5801 - protein, 150 aa, Panicum virgatum
MAGVNSTSVVGLKPAAAVPQAAAASPAAKRVQVAPKDRAAEGRRAALLGLAAVFAVTATTGSAKAGIIDEYLEKSKANKELNDKKRLATSGANFARAYTVEFGSCQFPYNFTGCQDLAKQKKVPFISDDLEIECEGKEKYKCGSNVFWKW

SEQ ID NO: 5802 - protein, 150 aa, Panicum virgatum
MAGVNSTSVVGLKPAAAVPQAATSSPAAKRVQVAPKDRAAEGRRAALLGLAAVFAVTATTGSAKAGIIDEYLEKSKANKELNDKKRLATSGANFSRAYTVEFGSCQFPYNFTGCQDLAKQKKVPFITDDLEIECEGKEKYKCGSNVFWKW

SEQ ID NO: 5803 - protein, 127 aa, Elaeis guineensis
MAGVNSTSVVGLKPAAAVPQAATSSPAAKRVQVAPKDRAAEGRRAALLGLAAVFAVTATTGSAKAGIIDEYLEKSKANKELNDKKRLATSGANFSRAYTVEFGSCQFPLQLHRLPGPRQAEESSLHH

SEQ ID NO: 5804 - protein, 143 aa, Cynodon dactylon
MAGVNTSIVGLKPAAAVPQAAASSPAKRVQVAPEGRRAALLGLAAVFAVTATTGSAKAGIIDEYLEKSKANKELNDKKRLATSGANFARAYTVEFGSCQFPYNFTGCQDLAKQKKVPFISDDLEIECEGKEKYKCGSNVFWKW

SEQ ID NO: 5805 - protein, 144 aa, Eragrostis curvula
MAGVNSSVVGLKPAAAVPQSAAASPVAKRVQVAPEGRRAALLGLAAVFAVTATTGAAKAGVIDEYLEKSKANKELNDKKRLATSGANFARAYTVEFGSCQFPYNFTGCQDLAKQKKVPFISDDLEIECEGKEKYKCGSNVFWKW

SEQ ID NO: 5806 - protein, 145 aa, Zea mays
MAGVNSSVVGLKPAAAVPQAAAASSPAKRVQLAAPEGRRAALLGLAAVFAVTATTGSAKATIFDEYLEKSKANKELNDKKRLATSGANFARAYTVEFGSCQFPYNFTGCQDLAKQKKVPFISDDLEIECEGKEKFKCGSNVFWKW

SEQ ID NO: 5807 - protein, 131 aa, Setaria italica
AVPQAASAAKRVQVAPKERAAEGRRAALLGLAAVFAVTATTGSAKAGIIDEYLEKSKANKELNDKKRLATSGANFARAYTVEFGSCQFPYNFTGCQDLAKQKKVPFISDDLEIECEGKEKYKCGSNVFWKW

SEQ ID NO: 5808 - protein, 146 aa, Triticum aestivum
GVNSSVVGLKPAAAVPQAAAAAASSQAKRVQLVAPEGRRAALLGLAAVFAVTATTGSAKAGIIDEYLEKSKANKELNDKKRLATSGANFARAYTVEFGSCTFPYNFTGCQDLAKQKKVPFITDDLEIECEGKEKFKCGSNVFWKWG

SEQ ID NO: 5809 - protein, 151 aa, Sorghum bicolor
MAGVNSSVVGLKPAAAVPQAAAAAASSQAKRVQLVAPEGRRAALLGLAAVFAVTATTGSAKAGIIDEYLEKSKANKELNDKKRLATSGANFARAYTVEFGSCTFPYNFTGCQDLAKQKKVPFITDDLEIECEGKEKFKCGSNVFWKWGEAK

SEQ ID NO: 5810 - protein, 149 aa, Oryza sativa
MAGVSTSVVGLKPAAAVPQSAASPVPKRVHVAVPPKEEQGGGRRAALLGLAAVFAATAAGQAKAGVFDEYLEKSKANKELNDKKRLATSGANFARAYTVEFGSCQFPYNFTGCQDLAKQKKVPFISDDLEIECEGKEKYKCGSNVFWKW

SEQ ID NO: 5811 - protein, 146 aa, Avena sativa
MAGVNSSVVGLKPAAAVPQSANASPAAAKRVQVAPAKDRRSALLGLAAVFAVTAATGSAQASVFDEYLEKSKLNKELNDKKRAATSGANFARAYTVQFGSCKFPYNFTGCQDLAKQKKVPFISDDLEIECEGKEKFKCGSNVFWKW

SEQ ID NO: 5812 - protein, 146 aa, Unknown
  Sequence found in Organisms: Festuca arundinacea, Lolium multiflorum
MAGVNSSVVGLKPAAAVPQSANASPAAAKRVQVAPAKDRRSALLGLAAVFAVTAATGSANASVFDEYLEKSKLNKELNDKKRAATSGANFARAYTVQFGSCKFPYNFTGCQDLAKQKKVPFISDDLEIECEGKEKFKCGSNVFWKW

SEQ ID NO: 5813 - protein, 75 aa, Secale cereale
MAGVNTSVVGLKPAAAVPQSASPAAAKRVQVAPAKDRRSALLGLAAVFAVTAATAGSARASSSTSTSRRASSTRS

SEQ ID NO: 5814 - protein, 145 aa, Unknown
  Sequence found in Organisms: Pseudoroegneria spicata, Secale cereale
MAGVNTSVVGLKPAAAVPQSASPAAAKRVQVAPAKDRRSALLGLAAVFAVTAATAGSARASVFDEYLEKSKLNKELNDKKRAATSGANFARAYTVQFGSCKFPYNFTGCQDLAKQKKVPFITDDLEIECEGKEKFKCGSNVFWKW

SEQ ID NO: 5815 - protein, 145 aa, Leymus cinereus x Leymus triticoides
MAGVNTSVVGLKPAAAVPQSASPAAAKRVQVAPAKDRRSALLGLAAVFAVTAASTGSARASVFDEYLEKSKLNKELNDKKRAATSGANFARAYTVQFGSCKFPYNFTGCQDLAKQKKVPFITDDLEIECEGKEKFKCGSNVFWKW

SEQ ID NO: 5816 - protein, 101 aa, Avena sativa
MAGVNSSVVGLKPAAAVPQSANASPAAAKRVQVPPGQGPAVGASRPSGRLRRHSCHRLRTGQRVRRVPREEQAQQGAERQEEGGHQRRQLRARLHRAVRQL

SEQ ID NO: 5817 - protein, 145 aa, Triticum aestivum
MAGVNTSVVGLKPAAAVPQSASPAAAKRVQVAPAKDRRSALLGLAAVFAVTAASAGSARASVFDEYLEKSKLNKELNDKKRAATSGANFARAYTVQFGSCKFPYNFTGCQDLAKQKKVPFITDDLEIECEGKEKFKCGSNVFWKW

SEQ ID NO: 5818 - protein, 142 aa, Brachypodium distachyon
MAGVNSSVVGLKPAAAVPQTAAAFSAKRVQVKDRRSALLGLAAVIAVTAGASGSARASVFDEYLEKSKLNKELNDKKRAATSGANFARAYTVQFGSCKFPYNFTGCQDLAKQKKVPFISDDLEIECEGKEKYKCGSNVFWKW

SEQ ID NO: 5819 - protein, 145 aa, Triticum aestivum
MAGVNTSVVGLKPAAAVPQSASPATAKRVQVAPPKDRRAALLGLAAVFAVTAASAGSARASVFDEYLEKSKLNKELNDKKRAATSGANFARAYTVQFGSCKFPYNFTGCQDLAKQKKVPFITDDLEIECEGKEKFKCGSNVFWKW

SEQ ID NO: 5820 - protein, 145 aa, Hordeum vulgare
MAGVNTSVVGLKPAAAVPQSASPAAAKRVQVAPAKDRRSALLGLAAVFAATAASAASARASVFDEYLEKSKLNKELNDKKRAATSGANFARAYTVQFGSCKFPYNFTGCQDLAKQKKVPFITDDLEIECEGKEKFKCGSNVFWKW

SEQ ID NO: 5821 - protein, 376 aa, Panicum virgatum
MAHDEAVATQKTGNTASSPKDQPAPSPYPDWSSMQAYYGPGVLPPTYFAPAIAPGHPPPYMWGPQPLMPHPFGTPYAAMYAHGTAYPHPLVPMVSNPLSVEPTKSANSKEKSSNKKLKEIDRTAVSAGSGNSKRAMSSSEDYSAEGSSDVNDQKVNKTSRKLSSVDGPAARIEGVIAPNHTLANTAILPHHCFPAPVVKTSTTNVANSRAMGGSISPYPGVIVPPHTGGPADLSIKDERELKREKRKQSNRESARRSRLRKQVETEELATQVESLTAENTSLRSEIGRLTESSEQLRLENSALMVKLKDPEVPAPAEPSPKATASSPSPRPTAENFLSMIDGTTSAPGASRHTEHGKPKLRQLLDSNPSTDVAAIS

SEQ ID NO: 5822 - protein, 382 aa, Sorghum bicolor
MAQDEAVATQKTGNTASPSKDYPTPSPYPDWSTMQAYYGPGVLPPTYFAPAIAPGHPPPYMWGPQPIMPPPFGTPYAAVYPHGGAYPHPLVPMMSTPLSMEPAKSANSKEKNSNKKLKEIDRTAVSAGSGNSKRTMSSSEDYSAEGSSDVNDQKVNKTSRKQNSDDGPGAETTTGANTECVLAPNHTMGNGAILPHHCFPAPVIKPSATNVANSRVIGTAISPSPSVMVPAHTALPADLSVKDERELKREKRKQSNRESARRSRLRKQAETEELATQVESLTTENTSLRSEIGRLTESSEKLRLENSALMVKLKDTAALTPAEPSPHTAVTSSSSPGAAAENFLSMIDSAKAAGVSRHTEHGEPKLRQLLDSSPATDVAAVS

SEQ ID NO: 5823 - protein, 378 aa, Saccharum officinarum
MAQDEAVAPQKTGNTASPSKDYPTPCPYPDWSTMQAYYGPGVLPPTYFAPAIAPGHPPPYMWGPQPIMPPPFGTPYAAVYPHGGAYPHPLVPMMSTPLSMEAAKSANSKEKTSNKKLKEIDRTSVSAGSGNSKRTMSSSEDYSAEGSSDVNDQKVNKTSRKRSSDDGPGAETTTGANTECVLAPNHTLGNAAILPHHCFPAPVIKPSATNIANSRAIGTEISPSPGVMVPAHTAVQSDLSIKDERELKREKRKQSNRESARRSRLRKQAETQELATQVESLTAENTSLRTEIGRLTESSEKLRLENSALMVKLKDTAAPTPADKAATSSSSPCAAAENFLSMIDSAKAAGVSRHTEHGEPNLRQLLDSSPAADVAAVS

SEQ ID NO: 5824 - protein, 143 aa, Setaria italica
MFSLNSIGPMVEMLSGPRRFIAVYISSALAGSLMSYRCCESPAVGASGAIFGLVGAHAVYMWRHRSYFGNARESLEHIGRVVVLNMGMGLLSRGIDNWGHLGGLLGGVAVAWFLGPAWQYQYVGKDGRVVFKDRAPVLRLIKG

SEQ ID NO: 5825 - protein, 341 aa, Sorghum bicolor
MASWLLLPLPSFPWPPPPPPGSSSGRGGGGGGDGGDWRPNVVAAFAGAQLGRSLRRRFAGLLRSPEVRHLDALPKMGDFWFEGSEPFATFPILGAIGNVLSAPYVCSSALFSGNGSGGRYISNGKLLSRRPRGIDSKKRLWTNVLLALNVLAYVAQVASQGKLLLWGAKINSLIDRGQFWRLATSSLLHADLTHLAFNCFSLNSIGPMVEMLTGPRRFLAVYFSSALAGSLMSYRCSASPAVGASGAIFGLVGAHAVYMWRHRRFFGNSRESLEHIGRVVVLNMGMGLLSRGIDNWGHLGGLLGGVAMAWFLGPAWQYQYVAKDGRAVFKDRAPVLRLIKG

SEQ ID NO: 5826 - protein, 341 aa, Zea mays
MASWLLLPFSSFPWPPPPPPGSSSGRGGDGGGDGGDWRPTVVAAFAGVQVGRALRRRFAGLLRSPEVRHLDALPKMGSFWFEGSESLATFHILGAIGIVFSAPYVCSSALFSGNGSGGRYISNGKLLSRRPRGIDSKKRLWTNVLLALNVLAYVAQVASQGKLLMWGAKINSLIDRGQFWRLATSSLLHANLTHLAFNCFSLNSIGPMVEMLSGPRRYLAVYFSSALAGSLMSYRFSASPAVGASGAIFGLVGAYAVYMWRHRRFFGNSRESLEHIGRVVVLNMGMGLLSRGIDNWGHLGGLLGGVAMAWFLGPAWQYQYVAKDGRAVFKDRAPVLRLIKG

SEQ ID NO: 5827 - protein, 266 aa, Setaria italica
MGDICFGGSHSFATHPILGALGNVFPASYVCSFTLFNGNGSGGTYIGKGKVLSRRPRRIDSKKRLWTNVLLAINVLAYIAQVASQGKLLMWGAKINSLIDRGQFWRLATSSLLHANVTHLAFNCFSLNSIGPMVEMLSGPRRFIAVYISSALAGSLMSYRCCESPAVGASGAIFGLVGAHAVYMWRHRSYFGNARESLEHIGRVVVLNMGMGLLSRGIDNWGHLGGLLGGVAVAWFLGPAWQYQYVGKDGRVVFKDRAPVLRLIKG

SEQ ID NO: 5828 - protein, 419 aa, Setaria italica
MGVGKVLNEVKPYLYMVLLMVGFSGMYIVSVASLRRGMSHFVLVVYRNFVGTVLMTPFALLFERYTTLIMNDDGSCPATRPHGEACYWSEAQDDAARLRQGHGARLAGACAGPEHVLPGREADLRGLRLGPRQHAPGGHLPHGARPQDGEAQAAEPPQPGQDPRHGLHRRRRRTHGPLPRPRRAVPVVQRRRPPPRCGGRRHGGEPKRRCLALRRRHGHRQLRVLGRLLHPPVEHAAELPGRDVADGAHLRRGHGDERRGGAFCGAPRHERLGHRLRHPPLHRRLLRDRVLRRGLLRAGASDAGARPGVRDGVPAPLHDLHHHHGLHHTQRRDHLGKRGWRGDHSGGALLPHLGQEQGPPRRRQARRRGRHRAAPDLGSDPQRQRIRQAARARRPCRYRRRDAGGHRDQVRLLTSRSIE

SEQ ID NO: 5829 - protein, 377 aa, Panicum virgatum
MGVGKVLNEVKPYLYMVLLQVGFSGMYIVSVASLRLGMSHFVLVVYRNLVATLLLAPFALLLERGVRPKMTPLIFLKVMGLVLLEPVLDQNMYYLGAKLTSAGFASALVNILPAVTFIMALLLRMERLRLRSLHSQAKIFGTVCTVAGAVLMVLYHGPVVEFPWTRGHHHAAAAGAAATQSGAAWLNGVAMVIGSCVTWAGFFILQSNTLQSYPAEMSLAALICGLGTLMSGAVALVAERRDMSVWAIGFDTRLFTVVYSGIVCSGVAFYVQGVVTQVRGPVFVTAFQPLCMIITTFLGSTILKEETTMGSVIGAAIIVVGLYSLIWGKSKDHLSKPGAAAVAELPTMTPPAIAANGKHALAAADVETPAAVAKCAY

SEQ ID NO: 5830 - protein, 1096 aa, Setaria italica
MRRGRGHGGGGVSASLAALLCCGCVMVLAGAAAAQGPWLPYAYKTLSGDAPRVVAKGGFSGVFPDSSSDAYSFTLMASAAGTTLWCDVQLTKDGVGVCLRDINMDNCTNVAQAYPARKRTYVIDGVRKNGWFALDFTKDELQSVILTQAIWSRTYSFDSVGYSILSVTDLLSIVKQPSVWLNVQHDTFYKEHGLNMRNYIFSIQKRVSVDYISSPELGFLQNISGTVRGKTKLVFSFLDKSLLDHSINRTYGSLLSNLTLIKSIAFGIMVPKTYIWPVTKDNYLQPSTSIVAEAHNAGLEIYASDFANDRIIPYNYSYDPLAEYLNFISDGGFSVDGVLSEHPFTASEAIGCLASLNSSKTDHGEPLVISHNGASGDYPDCTDLAYHSAINDGADVIDCPVQVTSDGVLMCMSSINLLDTTNVQGTTFSSRSSVVPEIQATAGIFTFNLTWDDINSSTLKPKISSPVSDYYLVRNPRYTNQGKFLKLSDFLAIGMDTDLSGVMIIIENAAFVAKSLGIDIVDSVNAALSAAGYDNQTTKQVLIQSKDSAVLVKLKQQKTKCKLVYTLPLGIGDASTSSLEAMKNFANAVVVDRKSVFTLSRAFAIRQNSLVKHLQSAGLAVYAQVFRNEFVSQPLDFFADETVEINYYVQSFNLSGIITDFPKTVRRYKKMPDYMQSIDVGSLYQLLQPFKAQPPSLPPMPTLNASSVEEPPLPPVASRKRDLLRLKIRKARKMREKFFKRNRGLLLRQLVDKDIAERMIFSLEELEKATNKFDEARILGGGGHGTVYKGILSNQRVVAIKVSRLVVQREIDEFINEVAILSQINHRNVVKLFGCCLETEVPLLVYEFVPNGTLYDHLHVDNPQRPLTWKDRLRIASEVASSLAYLHSAASTSVVHRDIKTSNILLDDRLTAKVSDFGASRGIAIDQSGVTTGIQGTFGYLDPEYYYTRRLTDKSDVYSYGVMLVELLTRTKIMYISPEGVSLVAHFVTSLDQGELNEILDEQVIEEGEEEGKQVAEIAAMCLRMKGEDRPTMRSVEMRLQGLLGSEINTSVIGEGHVNGLNGLTFQGGNANAGDNYCSRRYSIEEEILVSASLER

SEQ ID NO: 5831 - protein, 775 aa, Sorghum bicolor
MRRSRRQRNGRGGGSGQRGVRVAFAFAVLLGCVMPLVGGAAAQGPRLPSDYKTLSGAAPLVVAKGGFSGVFPDSSQGAYSFAMIASAPDTAMWCDVQLTKDGVGVCLRDINMKNCTTVDQAYPARTRTYVIDGVQKSGWFVSDFTIAELQSVSLTQAIWSRTERFDGIYPIVSVTDFRSLVMPSPVWLNVQHDIFYKQHGLDMRNYIFSIKKRVSMDYISSPELGFLKNISGRVGRKTKLVFRFLDKALLDHSINQTYGSLSSNLTFIKSIASGIIVPKSYIWPVTKDNYLLPSTSIVTEAHNAGLEIYASDFANDRIIPYNYSYDPLAEYLNFVNDGGFSVDGVLSEHPITASEAIGCFTKLNSNKTDHGEPLVISHNGASGDYPDCTDLAYHSAIDNGADIIDCPVQVTSDGVLMCMSSGNLLDTTNVQTTTYSSLVSVVPKIQPQPGIFTFNLTWADMNSNALKPKISSPASGYSLVRNPRYTNQGKFLKLSDFLAIAMDKDLSGVMIIIENAAFLINSLGIDIVDSVTTALSAAGFNNHPTKEVLIQSKDSAVLVKLKQKKTKSKLVYTLPSGIGDASNSSLKDIKKFAEAVVVDSKSVFTLSSDFIIRQNSLVQDLQSAGLALYAEVFRNEFVAQPLDFFGDETVEINYYVQSFNLSGIITDFPKTVRRYKKNTCTVLGNDMPNYMQPPQAGSLAQFLQTFKTQPPSLPPMPTLSSSSVEEPPLPTVASRSVSDGSSSGGTRTPGTPSDAHTATMSAGMLLVMVFTALLI

SEQ ID NO: 5832 - protein, 168 aa, Setaria italica
GLLEEKRMDGQGEKEMPARQRQEDEHLLSSLLTKPDALERDPDSDTLETHSLHPSHQPGRSETSKEVELADIAKDLNKIKRQNTVTHILLGAVIVLTAVWQVNEVSFLLWVQRKLSNPFKSLGDMIKGSLKLKGRKPVIESSPLPPVGVPDVSRPDLPSFVIGSTEGR

SEQ ID NO: 5833 - protein, 600 aa, Setaria italica
ADVDLGPDSDEHYISPNVKAPRVAGLLVKLLAWVLEMPVVGWIVLSVLKRDNLVYKLVSDAEIPEPPLFTATHTWQDIPEQNVRLTKPGLPPPERVQEAVVCLTAPLPEPAAELADPSPGFRRWTVRDFHEAYSSGQTTPVMVARRFLAAVKECSGPEVNMALFISCDAADVMRQAEDSTRRYQQGAPLSAMDGVLVAVKDELDCAPYPTTGGTRWLAAARRPCGAGDAACVAQLRACGAVMAGKANMHELGAGTSGINPHHGATRNPYCLARVSGGSSGGSAAAVCAGLCPVALGADGGGSVRMPAALCGVVGFKPTAGRLSNSGLLPLNWTVGMPGILAATVEDALIAYAAIVDQSKPSHLQPELNLPMLTCTRSMPNIRLAKYVKWFDDCSEDIRSLCGKALQMLRTQYGWECVDVTVPEIEEMRLAHYVTMGSECTASLAKYLDNMSKSEIGWDVRIGLSAYRSFSSRDYLNAQRLRNRQMFFHNKIFETADAIVTPMTGVTAYPLQEDALGTGELDYINGAALVRYSIAGNFLGLPAITVPVGYDTGGLPVGLQFIGRPWSEATLLHLAYATQEACAREHRKPKVHYDLLLSKEY

SEQ ID NO: 5834 - protein, 610 aa, Zea mays
MGFFIPPPKVYKPAAEVDLGPDSDEHYISPNVKAPRVAGFLVKMLAWVLETPVLGWIVLGVLKRDNLVYKLVSDAEIPEPPLFTATHTWQAAIQEQSVRVTESRLSPAERVQEAVACVPAAAQAQLEPAAGFRRWTVRDFHRAYRSGQATPTMVARRFLAAVEECSGPDLNMGFFISCDPADVLRQAEDSTRRYQQGAPLSAMDGVLVAVKDELDCLPYPTSGGTRWLGSARRCAADAACVAQLRACGAVMAGKANMHELGAGTSGINPHHGATRNPYNVGRVSGGSSGGSAAAVCAGLCPVALGADGGGSVRMPAALCGVVGFKPTAGRLSNSGLLPLNWTVGMPGILAATVEDTLIAYAAIADQSKPSPLQQPELNLPMLTRTRSMPSIRLAKYAKWFDDSSEDIRSLCGKALQMLRTHYGWESVDVTVPEIEEMRLAHYVTMGSECTASLAAKYLDSMDRSEVGWDVRIALSAYGSFSSRDYLSAQRLRCRQMYFHEKIFETADAIVTPMTGVTAYALQDDALSTGELDYINGAALVRYSIAGNFLGLPAITVPVGYDRGGLPVGLQFIGRPWSEATLLHLAYAMQEACGKKVLRKPKVHYDLLTKE

SEQ ID NO: 5835 - protein, 618 aa, Sorghum bicolor
MGLFSSPAKVYKPAAEVDLGPHSVAGEHYISPNVKAPRVAGLLVKMLAWVLETPVLGWIVLSVLKRDNLVYKLVSDAEIPEPPLFTATHTWQAAMPEKNVSVTEAGVSPAERVQVAVAGIPADMEPAATAAALADGPSSSFRRWTVRDFHSAYSSGQTTPVMVARRFLAAVEECSGPDRNMGLFISCDPGDVLRQAQESTRRYQQGAPLSAMDGVLVAVKDEIDCLPYPTTGGTRWLGSARRCVADAACVAQLRACGAVMAGKANMHELGAGTSGINPHHGSTRNPYNVGRVSGGSSGGSAAAVCAGLCPVALGADGGGSVRMPAALCGVVGFKPTAGRLSNSGLLPLNWTVGMPGILAATVEDTLIAYAAIADQSKPSPLQQPELNLPLLTSTRSIPNIRLAKYAKWFDDSSEDIRSLCGKALQMLRTHYGWESVEVTVPEIEEMRLAHYVTMGSECTASLAKYLNNMDRSEIGWDVRIALSAYGSFSSRDYLNSQRLRCRQMYFHEKIFETADAIVTPMTGVTAYALQDDALSTGELDYINGAALVRYSIAGNFLGLPAITVPVGYDREGLPVGLQFIGRPWSEATLLHLAYAMQESCGKEHCKKPKVHYDLLKKQ

SEQ ID NO: 5836 - protein, 576 aa, Panicum virgatum
WVLETPVLGWIVLTVLKRDNLVYKLVSDAEIPEPPLFTATHTWRDIPEQNVRRTKPGLSPAERVQEAVSCLPARLPEPAAALAVPGGPASGFRRWTVRDFHRAYSSGQTTPAMVARRFLTAVKECSDLKMAVFISCDAADVMRQAEDSTRRYQQGAPLSAMDGVLVAVKDELDCLPYPTTGGTRWLGAARRCAADAACVAQLRACGAVLAGKANMHELGAGTSGINPHHGSTRNPYDPARVSGGSSGGSAAAVCAGLCPVALGADGGGSVRMPAALCGVVGFKPTAGRLSNAGLLPLNWTVGMPGILAATVEDALIAYAAIVDQSKPSPLQQPELNLPLLTCTRSISNIKLAKYAKWFDDSSEDIRNLCGKALQMLKAQYGWETVEVTVPEIEEMRLAHYVTMGSECTASLAKYLNNMSRSEIGWDVRIGLSAYRSFSSRDYLNAQRLRCRQMYFHERIFEAADAIVTPMTGVTAYPLQDDALSTGELDYINGAALVRYSIAGNFLGLPAITVPVGHDGGGLPVGLQLVGRPWSEATLLHLAHAVQEACWEHRREPPKVHFDLLAPRQRLTTGLAP

SEQ ID NO: 5837 - protein, 610 aa, Oryza sativa
MGVFSSAPKVYKPASEVNLGADSNEFYISPNVKAPRVAGLLVKIFAWVLEAPIIGSIVLYILKRDNLVNKLVSDAEIPEPPLFTAAHTWQDIPEQNVSLTKPDMSPAERVQEAVVCLPARLESVLADPPSPGFRRWTIRDFTSAYISGEITPVMVARRFLAAVKECSGPDLNMALFISCNPQDVIRQAEASTLRYQQGAPLSAMDGVLVAVKDEIDCLPYPTTGGTRWLQRMRPCVQDAAVVAQLRACGAVLAGKTNMHELGAGTSGINPHHGSTRNPYNTGKVAGGSSGGSAAVVCAGLCPVALGADGGGSVRMPAALCGVVGLKPTAGRFSKDGLLPLNWTVGMPGILAATVEDALIAYAAIADQSQPSHLQPELNLPLLKAASSMPTIRLARYAKWFNDCSEDIRSCCYKAVHTLRTRYGWETADVTIPEIEEMRLAHYVTMGSECTASFDKYLKKLSKSEIGWDVRIALSAYGSFSSRAYLNSQRIRNRQMYFHDKIFETFDVIVTPMTGVTAHELQDNAGHTGELDYINGAALVRYSIAGNFLGLPAITVKVGYDREGLPVGLQFIGRPWSEATLLHLAYAMQEACGKNYRKPMVYYDLLNKNKY

SEQ ID NO: 5838 - protein, 202 aa, Setaria italica
MAVATETPFHVLAVDDSLPDRKLIERLLKTSSFHVTTVDSGSKALEFLGIHGEDSSPVSVHADQLEVAVNLIITDYCMPGMTGYDLLKKIKESSSLRDIPVVIMSSENIPSRINRCLEEGADEFFLKPVRLSDMSKLKPHILKSRCKEHYQEQHQQSDSNSNECSNPTDDSSSSSSDNSNSRKREAEDNEEILPQRNRSRHS

SEQ ID NO: 5839 - protein, 199 aa, Setaria italica
MAVATETPFHVLAVDDSLPDRKLIERLLKTSSFHVTTVDSGSKALEFLGIHGEDSSPVSVHADQLEVAVNLIITDYCMPGMTGYDLLKKIKESSSLRDIPVVIMSSENIPSRINRCLEEGADEFFLKPVRLSDMSKLKPHILKSRCKEHYQEQHQQSDSNSNECSNPTNDSSSSDNSSSRKRKAEDNEVLPQTNRLRHS

SEQ ID NO: 5840 - protein, 200 aa, Panicum virgatum
MAVATETPFHVLAVDDSLPDRKLIERLLKTSSFQVTTVDSGSKALKFLGIHGEDSSPPVSVHEDQLEVAVNLIITDYCMPGMTGYDLLKKIKESTSLRDIPVVIMSSENIPSRINRCLEEGADEFFLKPVRLSDMSKLKPHILKSRCKEQCHQEQQQQSDSNSNECSVPTSSSSDNSNGRKRKAEDNEEVLPQTNRSRHS

SEQ ID NO: 5841 - protein, 201 aa, Panicum virgatum
MAVATETPFHVLAVDDSLLDRKLIERLLKTSSFQVTTVDSGSKALEFLGIHGEDSSPPVSDADQLEVAVNLIITDYCMPGMTGYDLLKKIKESTSLRDIPVVIMSSENIPSRINRCLEEGADEFFLKPVRLSDMSKLKPHILKSRCKEHYHQEQHQQSDSDSNSNECSNPTNNSSSDNSNSRKRKAEDDEVLPQTNRSRHS

SEQ ID NO: 5842 - protein, 200 aa, Saccharum officinarum
MAVVATETPFHVLAVDDSLPDRKLIERLLKTSSFQVTTVDSGSKALQFLGIHDDDASTVSVHVHQLDVAVNLIITDYCMPGMTGYDLLKKIKESSSLRDIPVVIMSSENIPSRINRCLEEGADEFFLKPVRLSDMSKLKPHILKSRCREHYQQEQQHQQSDSNSNDCSNPTNKSSSDSSRKRKAEDNGEILPQKNRPRHS

SEQ ID NO: 5843 - protein, 236 aa, Sorghum bicolor
MPTNPSTHTSSLPSSTTLASCSSTLLFRSAMAAAAAAAVATETPFHVLAVDDSLPDRKLIERLLKTSSFQVTTVDSGSKALQFLGLHDDHSPVPVHTDQLDVAVNLIITDYCMPGMTGYDLLKKIKESSSLRDIPVVIMSSENIPSRINRCLEEGADEFFLKPVRLSDMNKLKPHILKSRCREHNHQEQLQQSDSNSEECSNPTSSSSSSGSSSNRKRKGADNEEILPQANRSRHS

SEQ ID NO: 5844 - protein, 200 aa, Saccharum officinarum
MAAAVATETPFHVLAVDDSLPDRKLIERLLKTSSFQVTTVDSGSKALQFLGLHDDHSPVPVHTDQLDVAVNLIITDYCMPGMTGYDLLKKIKESSSLRDIPVVIMSSENIPSRINRCLEEGADEFFLKPVRLSDMNKLKPHILKSRCREHYHQEQHHQSDSNSDECSNPTSNSSSSDSSSSRKRKGADNEKSCPGKQIKA

SEQ ID NO: 5845 - protein, 202 aa, Sorghum bicolor
MAVVATETPFHVLAVDDSLPDRKLIERLLKTSSFQVTTVDSGSKALQFLGIHDDDASTVSVHAHQLDVAVNLIITDYCMPGMTGYDLLKKIKESSSLRDIPVVIMSSENIPSRINRCLEEGADEFFLKPVRLSDMSKLKPHILKSRCREHSQQDQEQQHQQSDSNSNDCSNPTNKSSSDSSRKRKAEDNEEILPQKNRPRHS

SEQ ID NO: 5846 - protein, 202 aa, Sorghum bicolor
MAVVATETPFHVLAVDDSLPDRKLIERLLKTSSFQVTTVDSGSKALQFLGIHDDDASTVSVHAHQLDVAVNLIITDYCMPGMTGYDLLKKIKESSSLRDIPVVIMSSENIPSRINRCLEEGADEFFLKPVRLSDMSKLKPHILKSRCREHSQQDQEQQHQQSDSNSNDCSNPTNKSHSDSSRKRKAEDNEEILPQKNRPRHS

SEQ ID NO: 5847 - protein, 385 aa, Setaria italica
MAPLFAAASHASLIPLFSPDPAAARLVRGTLRSRTSGLRLRGAPRAAGRGRGRGRGSGGIPDEWGERSPPGAPEPPAQPDLPVDEDEWGGDTAEGNSRPIVVDEWGEPAEPEPEPEPEPPSAADPPSPSADNEWGKDPSAPAPAPAAEEVDEQAERREDLKRCLVDTVYGSELGFRASTEVRGEVVELVTQLEAVNPTPAPVEAPDLLDGNWILIYTAYSELLPILAAGATPFVKVKQISQEIDSKSMTIVNASTLTTPFASFSFSATASFEVQSPSRIEVQFKEGSFQPPAISSTVDLPEQVDIFGQKISLGPVQQVLNPLQQTFASIAGSISGQPPLKVQIPGNNRGRSWLLTTYLDKDFRISRGDGGLFILAKEGSPFLDQL

SEQ ID NO: 5848 - protein, 89 aa, Zea mays
MKSSTLLAILVLQALLVSAAVAKGPAGPTTKKQCWCGECTSWSGVWTCDDLLTKCAATCKNCVPVSTDKGATKYRCRDFLPENCGCKIH

SEQ ID NO: 5849 - protein, 89 aa, Zea mays
MKSRSSTLLVILVLQALLLSAAVAKGPAGPKKQCWCGECTSWSGVWTCDDLLTKCAATCKNCVPVSTGKGATKYRCRDFLPENCGCKIH

SEQ ID NO: 5850 - protein, 103 aa, Zea mays
PSGLCGRGQRTCRADDEEAVLVRRVHQLVGRVDLRRPPHQVRRHLQELRPRVHGQGHHQVQVPRLPPRKLRLQDPLDSSTAAQPMDPSMLLRPSALLQAGSHQ

SEQ ID NO: 5851 - protein, 84 aa, Saccharum officinarum
MKSSTLLAILVLQALLVSAAVAKGQGPKKPCCNECTSWSGVYTCDDLLTKCAATCKTCVPVSTDKGTRYRCRDFLPEGCPCKTN

SEQ ID NO: 5852 - protein, 304 aa, Sorghum bicolor
MDIDLFADIDLDALLASFSGEPAAVSDLIVPSPPPPAPAAHDAAEAGSPESVTSRANPAGEVGLSEIERFLMQEGEAEAELGGEVEGISVDQFFDALYDGGEGKDEGEAEAGASTDADSGRDEVVEVVTPEAETVEVDGDDPVSKKKKRQMRNRDSAMKSRERKKSYIKDLETKSKYLEAECRRLSYALQCYAAENMVLRQSLMKDRPVGAPTAMQESAVLTETLPLVSLLWLVSIVCLFLMPVLPNRSPAAPSSGGRDLVMAAGKTSSETPEILELILHGRRCKSTRARIKLYNLPFHPVIAC

SEQ ID NO: 5853 - protein, 303 aa, Setaria italica
MDIDLFADIDLDALLASFSGEPAGVSGLIDPSPPPPAPTAAHDAEAGSPESVTSRASPPGEEALTEIERLLMQEGEAELGGEAEGISVEEFFDALYDGGEGEREGKESEAGGSTDGDSGRDEVVEVVTPEAETVEVDGDDPVSKKKRRQMRNRDSAMKSRERKKTYVKDLEAKSKYLEAECRRLSYALQCYAAENMVLRQSLLKDRPVGAPTAMQESAVLTETLPLVSLLWLVSIVCLFLMPGLPNRSPAAPSSAGRDLGMVTGKTSSENPDILELILHGRRCKGTRAKIKLDKLPFHAVAAC

SEQ ID NO: 5854 - protein, 302 aa, Panicum virgatum
VDLFADIDLDALLASFSGEPTGVSDLIVPSPPPPAPAPARDAEAGSPESVTSRASPPGEEALTEIERFLMQEGEAELGGEAEGISMEEFFDALYDGGEGEREGKESEAGGSTDEDSGRDEVVEVVTPEVETVEVDDDDPVSKKKKMRKMRNRDSAMKSRERKKTYIKDLETKSKYLEAECRRLSYALQCYAAENMALRQSLLKDRLVGAPTAMQESAVLTETLPLVSLLWLVSIVCLFLMPGLPNRSPAAPSSAGRDLGMVAGKTSSENPEILELILHGRRCKGTRAKIKLDTVPFHEVAAC

SEQ ID NO: 5855 - protein, 114 aa, Unknown
  Sequence found in Organisms: Sorghum bicolor, Saccharum officinarum
MPRATSDAKLLIQSLGKAYAATPTNLKIIDLYVVFAVATALIQVAYMGLVGSFPFNSFLSGVLSCIGTAVLAVCLRIQVNKDNKEFKDLPPERAFADFVLCNLVLHLVIMNFLG

SEQ ID NO: 5856 - protein, 114 aa, Oryza sativa
MPRATSDAKLLIQSLGKAYAATPTNLKIIDLYVVFAVATALIQVVYMGIVGSFPFNSFLSGVLSCIGTAVLAVCLRIQVNKDNKEFKDLPPERAFADFVLCNLVLHLVIMNFLG

SEQ ID NO: 5857 - protein, 114 aa, Setaria italica
MPRATSDAKLLIQSLSNAYAATPTNLKIIDLYVICAVATALIQVAYMGLVGSFPFNSFLSGVLSCIGTAVLAVCLRIQVNKDNKEFKDLPPERAFADFVLCNLVLHLVIMNFLG

SEQ ID NO: 5858 - protein, 115 aa, Pennisetum glaucum
MSDLDVQIPTAFDPFAEANAGDSGAAAGSKDYVHVRIQQRNGRKSLTTVQGLKKEFSYSKILKDLKKEFCCNGTVVQDPELGQVIQLQGDQRKNVSNFLVQAGIVKKEHIKIHGF

SEQ ID NO: 5859 - protein, 114 aa, Pennisetum glaucum
MPRATSDANLLIQSLSKAYAATPTNLKIIDLYVICAVATALIQVAYMGLVGSFPFNSFLSGVLSCIGTAVLAVCLRIQVNKDNKEFKDLPPERAFADFVMCNLVLHLVIMNFLG

SEQ ID NO: 5860 - protein, 114 aa, Panicum virgatum
MPRSTSDAKLLIQSLSKAYAATPTNLKIIDLYVICAVATAVIQVAYMGLVGSFPFNSFLSGVLSCIGTAVLAVCLRIQVNKDNKEFKDLPPERAFADFVLCNLVLHLVIMNFLG

SEQ ID NO: 5861 - protein, 114 aa, Panicum virgatum
MPRATSDAKLLIQSLNKAYAATPTNLKIIDLYVICALATAVIQVAYMGLVGSFPFNSFLSGVLSCIGTAVLAVCLRIQVNKDNKEFKDLPPERAFADFVLCNLVLHLVIMNFLG

SEQ ID NO: 5862 - protein, 114 aa, Panicum virgatum
MPRATGDAKLLIQSLNKAYAATPTNLKIIDLYVICALATAMIQVAYMGLVGSFPFNSFLSGVLSCIGSAVLAVCLRIQVNKDNKEFKDLPPERAFADFVLCNLVLHLVIMNFLG

SEQ ID NO: 5863 - protein, 114 aa, Panicum virgatum
MPRAPGDAKLLIQSLNKAYAATPTNLKIIDLYVICAVATAVIQIAYMGLVGSFPFNSFLSGVLSCIGTAVLAVCLRIQVNKDNKEFKDLPPERAFADFVLCNLVLHLVIMNFLG

SEQ ID NO: 5864 - protein, 114 aa, Eragrostis curvula
MPSATSDARVLIQSLIRAYAATPTNLKIIDLYVVFAVATALVQVAYMGLVGTFPFNSFLSGVLSCIGTAVLAVCLRIQVNKDNKEFKDLPPERAFADFVLCNLVLHLVIMNFLG

SEQ ID NO: 5865 - protein, 91 aa, Setaria italica
AAVEASSYSPSSSLLFPSRRSRGTGARDATYLLPCLLASSGRLRFFKMPRATSDAKLLIQSLSNAYAATPTNLKIIDLYVIWPLFRLLTWD

SEQ ID NO: 5866 - protein, 114 aa, Secale cereale
MPKAAGDAKLLIQSLSKAYAATPTNLKIIDLYVVFAVATALVQVVYMGIVGSFPFNSFLSGVLSCIGTAVLGVCLRIQVNKDNKEFKDLPPERAFADFVLCNLVLHLVIMNFLG

SEQ ID NO: 5867 - protein, 114 aa, Secale cereale
MPKAAGDAKLLIQSLTKAYAATPTNLKIIDLYVVFAVATALVQVVYMGIVGSFPFNSFLSGVLSCIGTAVLGVCLRIQVNKDNKEFKDLPPERAFADFVLCNLVLHLVIMNFLG

SEQ ID NO: 5868 - protein, 114 aa, Cynodon dactylon
MPRATSDAMLLVQSLRKAYAATPTNLKIIDLYVVFAIATSLIQVAYMGLVGTFPFNSFLSGVLSGIGSAVLAVCLRIQVNKDNKEFKDLPPERAFADFVLCNLVLHLVIMNFLG

SEQ ID NO: 5869 - protein, 114 aa, Avena sativa
MPKAAGDAKLLIQSLNKAYAATPTNLKIIDLYVIFAVTTALVQVVYMGIVGSFPFNSFLSGVLSCIGTAVLAVCLRIQVNKDNKEFKDLPPERAFADFVLCNLVLHLVIMNFLG

SEQ ID NO: 5870 - protein, 114 aa, Pseudoroegneria spicata
MPKAAGDAKLLIQSLTKAYAATPTNLKIIDLYVLFAVATALVQVVYMGIVGSFPFNSFLSGVLSCIGTAVLGVCLRIQVNKDNKEFKDLPPERAFADFVLCNLVLHLVIMNFLG

SEQ ID NO: 5871 - protein, 114 aa, Hordeum vulgare
MPKAAGDAKLLIQSLNKAYAATPTNLKIIDLYVVFAVATALVQVVYMGIVGSFPFNSFLSGVLSSIGTAVLGVCLRIQVNKDNKEFKDLPPERAFADFVLCNLVLHLVIMNFLG

SEQ ID NO: 5872 - protein, 114 aa, Brachypodium distachyon
MPKAAGDAKLLIQSLSKAYAATPTNLKIIDLYVVFAVATAVVQVVYMGVVGSFPFNSFLSGVLSCIGTAVLAVCLRIQVNKDNKEFKDLAPERAFADFVLCNLVLHLVIMNFLG

SEQ ID NO: 5873 - protein, 114 aa, Avena sativa
MPKAAGDAKLLIQSLNKAYAATPTNLKIIDLYVVFAVASALVQVVYMGIVGSFPFNSFLSGVLSCIGTAVLAVCLRIQVNKDNKEFKDLAPERAFADFVLCNLVLHLVIMNFLG

SEQ ID NO: 5874 - protein, 114 aa, Triticum aestivum
MPKPAGDAKLLIQSLTKAYAATPTNLKIIDLYVVFAVATALVQVVYMGIVGSFPFNSFLSGVLSCIGTAVLGVCLRIQVNKDNKEFKDLPPERAFADFVLCNLVLHLVIMNFLG

SEQ ID NO: 5875 - protein, 114 aa, Triticum aestivum
MPKAAGDAKLLVQSLTKAYAATPTNLKIIDLYVVFAVATALVQVVYMGIVGSFPFNSFLSGVLSCIGTAVLGVCLRIQVNKDNKEFKDLPPERAFADFVLCNLVLHLVIMNFLG

SEQ ID NO: 5876 - protein, 114 aa, Hordeum vulgare
MPKAAGDAKLLIQSLNKAYAATPTNLKIIDLYVVFAVVTALLQVVYMGIVGSFPFNSFLSGVLSCIGTAVLAVCLRIQVNKDNKEFKDLAPERAFADFVLCSLVLHLVIMNFLG

SEQ ID NO: 5877 - protein, 114 aa, Eragrostis curvula
MPRATSDARVLIQSLSTAYAATPKNLKIIDLYVVFAVATALVQVAYMGLVGTFPFNSFLSGVLSCMGTAVLAVCLRIQVNKDNKEFKDLPPERALADLVLCNLVLHLVIMNFLG

SEQ ID NO: 5878 - protein, 114 aa, Avena sativa
MPKAAGDAKLLIQSLNKAYAATPTNLKIIDMYVVFAVASALVQVVYMGIVGSFPFNSFLSGVLSCIGTAVLAVCLRIQVNKDNKEFKDLAPERAFADFVLCNLVLHLVIMNFLG

SEQ ID NO: 5879 - protein, 107 aa, Avena sativa
MPKAAGDAKLLIQSLNKAYAATPTNLKIIDLYVVFAVASALVQVVYMGIVGSFPFNSFLSGVLSCIGTAVLAVCLRIQVNKDNKEFKDLAPERAFADLSCAIWCSTS

SEQ ID NO: 5880 - protein, 114 aa, Secale cereale
DAEGRGDAKLLIQSLTKAYAATPTNLKIIDLYVVFAVATALVQVVYMGIVGSFPFNSFLSGVLSCIGTAVLGVCLRIQVNKDNKEFKDLPPERAFADFVLCNLVLHLVIMNFLG

SEQ ID NO: 5881 - protein, 114 aa, Secale cereale
MPKAAGDAKLLIQSLNKAYSATPTSLKIIDLYVVFAIVTALVQVVYMGVVGSFPFNSFLSGVLSCIGTAVLAVSLRIQVNKDNKEFKDLPPERAFADFVLCNLVLHLVIMNFLG

SEQ ID NO: 5882 - protein, 114 aa, Secale cereale
MPKAAGDAKLLIQSLNKAYSATPTSLKIIDLYVVFAIVTALVQVVYMGIVGSFPFNSFLSGVLSCIGTAVLAVSLRIQVNKDNKEFKDLPPERAFADFVLCNLVLHLVIMNFLG

SEQ ID NO: 5883 - protein, 114 aa, Triticum aestivum
MPKADGDATLLIQSLNKAYAATPTNLKIIDLYVVFAVVTALVQVGYMGIVGSLPFNSFLSGVLSCIGTAVLAACLRIQVNKDNKEFKDLPPERAFADFVLCNLVLHLVIINFLG

SEQ ID NO: 5884 - protein, 115 aa, Cleome spinosa
MARSTSKDAQDLFHSLRSAYAATPTNLKIIDLYVGFAVFTALIQVAYMALVGSFPFNSFLSGVLSCVGTAVLAVCLRIQVNKENKEFKDLPPERAFADFVLCNLVLHLVIINFLG

SEQ ID NO: 5885 - protein, 115 aa, Ricinus communis
MARSTSKDAQALFNSLRSAYAATPTTLKIIDLYVGFAVFTALIQVVYMGIVGSFPFNSFLSGVLSCVGTAVLAVCLRIQVNKENKEFKDLPPERAFADFVLCNLVLHLVIMNFLG

SEQ ID NO: 5886 - protein, 115 aa, Tropaeolum majus
MARSTSKDAQALFQTLRSAYAATPTNLKIIDLYVGFAVFTALIQVAYMAVVGSFPFNSFLSGVLSCVGTAVLAVCLRIQVNKENKEFKDLAPERAFADFVLCNLVLHLVIMNFLG

SEQ ID NO: 5887 - protein, 115 aa, Fagus grandifolia
MARSTSKDAQALFHSLRSAYAATPTNLKIIDLYVVFAVFTALIQVVYMAIVGSFPFNSFLSGVLSCIGTAVLAVCLRIQVNKENKEFKDLPPERAFADFVLCNLVLHLVIMNFLG

SEQ ID NO: 5888 - protein, 408 aa, Ricinus communis
MKITGGGGSISEVLVLIPSTGALDLRSPPHLRHHHHHFHSFSFLSSALFKRCPSFGMPKQGIGTIKWRQRGLTLRASGDANNYSVPLPPLKFESPVGQLLAQILQTHPHLLPSAIDQQLENLQSDRDASTDQSPSSQDLLYKRIAEVKEKERRKTLEEIIYSLIVQKFLDNDILMIPKVSATSDPTGRVDFWPNQEQKLESVHSPEAFEMILSHLTLVLGERVVGPLETIVQISKIKLGKLYAASIMYGYFLRRVDERFQLERTMNTLPKDYDENRARYDEPSPMNRLWDPDSLIRIQPDNGGFMDTVEGKSYRLRSYVMYLDVETLQRYATIRSKEAMSLIEKQTQALFGRPDIRIAEDGSIDTANDEVISITFSGLTMLVLEAVAFGSFLWEGESYVESKYHFISS

SEQ ID NO: 5889 - protein, 117 aa, Secale cereale
MPKAAGDAKLLIQSLNKAYSATPTSLKIIDLYVVFAIVTALVQVVYMGVVGSFPFNSFLSGVLSCIGTAVLAVSLRIQVNKDNKDNKEFKDLPPERAFADFVLCNLVLHLVIMNFLG

SEQ ID NO: 5890 - protein, 115 aa, Carpinus betulus
MARSTSKDAQALIQSLRSAYAATPTNLKIIDLYVVFAIFTALIQVVYMAIVGSFPFNAFLSGVLSCTGTAVLAVCLRIQVNKENKEFKDLPPERAFADFVLCNLVLHLVIMNFLG

SEQ ID NO: 5891 - protein, 115 aa, Eutrema halophilum
MARSTSKDAQDLFHSLRSAYAATPTNLKLIDLYVCFAVFTALIQVAYMALVGSFPFNSFLSGVLSCIGTAVLAVCLRIQVNKENKEFKDLAPERAFADFVLCNLVLHLVIINFLG

SEQ ID NO: 5892 - protein, 115 aa, Amaranthus tuberculatus
MAKSSSKDAQALFQSLRSAYAATPTNLKIIDLYVIFAVSTALIQVAYMAIVGSFPFNSFLSGVLSCVGTAVLAVCLRIQVNKENKEFKDLPPERAFADFVLCNLVLHLVIMNFLG

SEQ ID NO: 5893 - protein, 115 aa, Manihot esculenta
MARSTGKDAQALFSSLRSAYAATPTSLKIIDLYVGFAVFTALIQVVYMAVVGSFPFNSFLSGVLSCIGTAVLAVCLRIQVNKENKEFKDLPPERAFADFVLCNLVLHLVIMNFLG

SEQ ID NO: 5894 - protein, 115 aa, Manihot esculenta
MARSTGKDAQALFSSLRAAYAATPTSLKIIDLYVGFAVFTALIQVVYMAIVGSFPFNSFLSGVLSCIGTAVLAVCLRIQVNKENKEFKDLPPERAFADFVLCNLVLHLVIMNFLG

SEQ ID NO: 5895 - protein, 115 aa, Unknown
  Sequence found in Organisms: Citrus sinensis, Citrus clementina
MARSTGKDAQALFHSLRSAYAATPTTLKIIDLYVGFAVFTALIQVVYMAIVGSFPFNSFLSGVLSCVGTAVLAVCLRIQVNKDNKEFKDLPPERAFADFVLCNLVLHLVIMNFLG

SEQ ID NO: 5896 - protein, 115 aa, Populus trichocarpa
MGRTTSKDAQALIHSLRSAYAATPTSLKIIDLYVGFAVFAAIIQVVYMAIVGSFPFNSFLSGVLSCIGTAVLAVCLRIQVNKENKEFKDLPPERAFADFVLCNLVLHLVIMNFLG

SEQ ID NO: 5897 - protein, 110 aa, Fagopyrum esculentum
MVRATSKDAQALFQSLLSAYTATPTSLKIIDLYVGFACSTALIQVAYMALVGTFPFNSFLSGVLSCVGTAVLAVCLRIQVNKETRNLRIYLQNAHLQTLFFATWCFTWLL

SEQ ID NO: 5898 - protein, 109 aa, Secale cereale
MPKAAGDAKLLIQSLTKAYAATPTNLKIIDLYVVFAVATALVQVVYMGIVGSFPFNSFLSGVLSCIGTAVLGVCLRIQVNKDNEGIQGLRTPGNGPLQYSSCAISCSTW

SEQ ID NO: 5899 - protein, 124 aa, Fagus grandifolia
KHCKKNRVGNGEATSKDAQALFHSLRSAYAATPTNLKIIDLYVVFAVFTALIQVVYMAIVGSFPFNSFLSGVLSCIGTAVLAVCLRIQVNKENKEFKDLPPERAFADFVLCNLVLHLVIMNFLG

SEQ ID NO: 5900 - protein, 116 aa, Coffea canephora
MARSSTAKDAQALIQSLRSAYAATPTNLKIIDLYIIFAVSTALIQVVYMALVGSFPFNSFLSGVLSCVGTAVLAVCLRIQVNKENKEFKDLPPERAFADFVLCNLVLHLVIMNFLG

SEQ ID NO: 5901 - protein, 116 aa, Capsicum annuum
MAKPSATKDAQALFHSLRSAYAATPTNLKIIDLYVVFAISTALIQVVYMALVGSFPFNSFLSGVLSCIGTAVLAVCLRIQVNKENKEFKDLPPERAFADFVLCNLVLHLVIMNFLG

SEQ ID NO: 5902 - protein, 115 aa, Eucalyptus grandis
MARSSGDDAQALFHSLRSAYAATPKNLKIIDLYVAFAVFTALIQVVYMALVGSFPFNSFLSGVLSCIGTAVLAVCLRIQVNKENKEFKDLPPERAFADFVLCNLVLHLVIMNFLG

SEQ ID NO: 5903 - protein, 115 aa, Unknown
  Sequence found in Organisms: Arabidopsis lyrata, Eutrema halophilum
MVKSTSKDAQDLFRSLRSAYSATPTNLKIIDLYVVFAVFTALIQVAYMALVGSFPFNSFLSGVLSCIGTAVLAVCLRIQVNKENKEFKDLAPERAFADFVLCNLVLHLVIINFLG

SEQ ID NO: 5904 - protein, 115 aa, Citrullus lanatus
MARSTSKDAQALFQSLRSAYAATPTTLKIIDLYVIYAVFTALIQVAYMAIVGSFPFNSFLSGVLSCIGTAVLAVCLRIQVNKENKEFKDLAPERAFADFVLCNLVLHLVIINFLG

SEQ ID NO: 5905 - protein, 115 aa, Arabidopsis thaliana
MVKSTSKDAQDLFHSLHSAYTATPTNLKIIDLYVCFAVFTALIQVAYMALVGSFPFNSFLSGVLSCIGTAVLAVCLRIQVNKENKEFKDLAPERAFADFVLCNLVLHLVIINFLG

SEQ ID NO: 5906 - protein, 115 aa, Aristolochia fimbriata
MAKSTSKDAQALVQSLRSAYSATPTNLKIIDLYVVFAVLTAVIQVGYMAIVGSFPFNSFLSGVLSCIGTAVLAVCLRIQVNKENKEFKDLPPERAFADFVLCNLVLHLVIMNFLG

SEQ ID NO: 5907 - protein, 115 aa, Unknown
  Sequence found in Organisms: Brassica juncea, Raphanus sativus
MVKSTSKDAQDLFRSLHSAYSATPTNLKIIDLYVVFAVFTALIQVAYMALVGSFPFNSFLSGVLSCIGTAVLAVCLRIQVNKENKEFKDLAPERAFADFVLCNLVLHLVIINFLG

SEQ ID NO: 5908 - protein, 115 aa, Musa acuminata
MAKSNASDAQALIRSLRSAYAATPTNLKIIDLYVVFAIATAIIQVVYMGIVGSFPFNSFLSGVLSCVGTAVLAVCLRIQVNKENKEFKDLPPERAFADFVLCNLVLHLVIMNFLG

SEQ ID NO: 5909 - protein, 115 aa, Ricinus communis
MARSTSRDAQALFHSLRSAYAATPTSLKIIDLYVGFAVFTALIQVVYMAIVGSFPFNSFLSGVLSCVGTAVLAVCLRIQVNKENKEFKDLTPERAFADFVLCNLVLHLVIMNFLG

SEQ ID NO: 5910 - protein, 115 aa, Castanea mollissima
MVKSTSKDAHALFHSLRSAYAATPTNLKIIDLYVVFSVFTALIQVVYMAIVGSFPFNSFLSGVLSCIGTAVLAVCLRIQVNKENKEFKDLPPERAFADFVLCNLVLHLVIMNFLG

SEQ ID NO: 5911 - protein, 115 aa, Cucumis sativus
MARSTSKDAQALFQSLFSAYAATPTTLKIIDLYVIYAVFTALIQVAYMAIVGSFPFNSFLSGVLSCIGTAVLAVCLRIQVNKENKEFKDLAPERAFADFVLCNLVLHLVIINFLG

SEQ ID NO: 5912 - protein, 115 aa, Cucumis melo
MARSTSKDAQALFQSLCSAYAATPTTLKIIDLYVIYAVFTALIQVAYMAIVGSFPFNSFLSGVLSCIGTAVLAVCLRIQVNKENKEFKDLAPERAFADFVLCNLVLHLVIINFLG

SEQ ID NO: 5913 - protein, 115 aa, Momordica charantia
MARSTSKDAQALFQSLRSAYAATPTSLKIIDLYVIYAVFTALIQVAYMAIVGSFPFNSFLSGVLSCIGTAVLAVCLRIQVNKENKEFKDLAPERAFADFVLCNLVLHLVIINFLG

SEQ ID NO: 5914 - protein, 115 aa, Carica papaya
MARSTGKDARALFHSLLSAYAATPTNLKVIDLYVGFAVFTALIQVVYMAIVGSFPFNSFLSGVLSCVGTAVLAVCLRIQVNKENKEFKDLPPERAFADFVLCNLVLHLVIMNFLG

SEQ ID NO: 5915 - protein, 122 aa, Aquilegia formosa
MAKLSTSSSSTTTSDAKALFQTLRSAYSATPTNLKIIDLYVIFAILTALIQVVYMALVGSFPFNSFLSGVLSCVGTAVLAVCLRIQVNKENKEFKDLPPERAFADFVLCNLVLHLVIMNFLG

SEQ ID NO: 5916 - protein, 117 aa, Bupleurum chinense
MGKSSATSKDAQLLFQSLRSAYAATPTNLKIIDLYVIFAVSTAVIQVVYMAIVGSFPFNSFLSGVLSCVGTAVLAVCLRIQVNKENKEFKDLPPERAFADFVLCNLVLHLVIMNFLG

SEQ ID NO: 5917 - protein, 116 aa, Arabidopsis lyrata
MARSSTSKDAQDLFHSLRSAYLATPTNLKIIDLYVCFAVFTALIQVAYMSLVGSFPFNSFLSGVLSCIGTAVLAVCLRIQVNKENKEFKDLAPERAFADFFLCNLVLHLVIINFLG

SEQ ID NO: 5918 - protein, 116 aa, Solanum tuberosum
MAKSSATKDAQALFHSLRSAYAATPTNLKIIDLYVIFAISTALIQVAYMAIVGSFPFNSFLSGVLSCIGTAVLAVCLRIQVNKENKEFKDLPPERAFADFVLCNLVLHLVIMNFLG

SEQ ID NO: 5919 - protein, 108 aa, Brassica napus
MVKSTSKDAQDLFRSLHSAYSATPTNLKIIDLYVVFSVFTALIQVAYMALVGSFPFNSFLSGVLSCIGTAVLAVCLRIQVNKETRNSRIWHRNEHLLISFSATWSCTW

SEQ ID NO: 5920 - protein, 108 aa, Cucurbita pepo
MARSTSKDAQALFQSLRSAYAATPTTLKIIDLYVMYAVFTALIQVAYMAIIGSFPFNSFLSGVLSCIGTAVLAVCLRIQVNKEIRNSRIWLRSELLQISFFATWFSIW

SEQ ID NO: 5921 - protein, 108 aa, Cucurbita pepo
MARSTSKDAQALFQSLRSAYAATPTTLKIIDLYVIYAVFTALIQVAYMAIVGSFPFNSFLSGVLSCIGTAVLAVCLRIQVNKETRSSRIWPRSELLLISFCATWFSIW

SEQ ID NO: 5922 - protein, 110 aa, Fagopyrum esculentum
MARPTSKDTQALFHSLLSAYTATPTSLKIIDLYVGFACFTALIQVAYMALVGTFPFNSFLSGVLSCVGTAVLAVCLRIQVNKETRNLRIYLQNVHLQTLFFATWCSTWLL

SEQ ID NO: 5923 - protein, 115 aa, Unknown
  Sequence found in Organisms: Brassica napus, Brassica juncea, Brassica rapa, Raphanus sativus
MVKSTSKDAQDLFRSLHSAYSATPTNLKIIDLYVVFAVFTALIQVAYMALVGSFPFNSFLSGVLSCVGTAVLAVCLRIQVNKENKEFKDLAPERAFADFVLCNLVLHLVIINFLG

SEQ ID NO: 5924 - protein, 115 aa, Euonymus alatus
MARSTSKDAQDLLHTLRSAYAATPTSLKIIDLYVIFAVFTALIQVVYMAVVGSFPFNSFLSGVLSCVGTAVLAVCLRIQVNKENKEFKDLPPERAFADFVLCNLVLHLVIMNFLG

SEQ ID NO: 5925 - protein, 115 aa, Fagopyrum esculentum
MARTTTKDAQALFQSLIAAYGATPTNLKIIDLYVVFAVSTALIQAVYMALVGTFPFNSFLSGVLSCVGTAVLAVCLRIQVNKENKEFKDLPPERAFADFVLCNLVLHLVIMNFLG

SEQ ID NO: 5926 - protein, 115 aa, Humulus lupulus
MARSTTKDAQALFQSLRSAYAATPTNLKVIDLYVVFAIMTAFIQVAYMAIVGSFPFNSFLSGVLSCIGTAVLAVCLRIQVNKENKEFKDLPAERAFADFVLCNLVLHLVIMNFLG

SEQ ID NO: 5927 - protein, 115 aa, Phalaenopsis aphrodite
MAKPASNDILTLIRSLRSAYAATPTNLKIIDLYVIFAIATAFIQVVYMGIVGSFPFNSFLSGVLSCVGTAVLAVCLRIQVNKENKEFKDLPPERAFADFVLCNLVLHLVIMNFLG

SEQ ID NO: 5928 - protein, 115 aa, Eutrema parvulum
MVKSTSKDAQDLFLSLRSAYSATPTNLKIIDLYVVFAVFTALIQVVYMALVGSFPFNSFLSGVLSCIGTAVLAVCLRIQVNKENKEFKDLAPERAFADFVLCNLVLHLVIINFLG

SEQ ID NO: 5929 - protein, 115 aa, Arabidopsis thaliana
MVKSTSKDAQDLFRSLRSAYSATPTNLKIIDLYVVFAVFTALIQVVYMALVGSFPFNSFLSGVLSCIGTAVLAVCLRIQVNKENKEFKDLAPERAFADFVLCNLVLHLVIINFLG

SEQ ID NO: 5930 - protein, 115 aa, Unknown
  Sequence found in Organisms: Brassica juncea, Brassica rapa
MVKSTSKDAQDLFRSLHSAYSATPTNLKIIDLYVVFSVFTALIQVAYMALVGSFPFNSFLSGVLSCIGTAVLAVCLRIQVNKENKEFKDLAPERAFADFVLCNLVLHLVIINFLG

SEQ ID NO: 5931 - protein, 115 aa, Phaseolus coccineus
MARSSSKDAQDLFRALWSAYAATPTNLKIIDLYVMFAVFTALIQVVYMALVGSFPFNSFLSGVLSCVGTAVLAVCLRIQVNKENKEFKDLAPERAFADFVLCNLVLHLVIMNFLG

SEQ ID NO: 5932 - protein, 115 aa, Cleome gynandra
MARSTSKDAQDLFHSLRYAYSATPTNLKIIDLYVGFAVFTSLIQVAYMALVGTFPFNSFLSGVLSCVGTAVLAVCLRIQVNNENKEFKDLPPERAFADFILCNLVLHLVIMNFLG

SEQ ID NO: 5933 - protein, 115 aa, Cyamopsis tetragonoloba
MARSSSKDAQDLFRALWSAYTATPTNLKIIDLYVAFAVFTALIQVVYMALVGSFPFNSFLSGVLSCIGTAVLAVCLRIQVNKENKEFKDLAPERAFADFVLCNLVLHLVIMNFLG

SEQ ID NO: 5934 - protein, 115 aa, Glycyrrhiza uralensis
MARSSSKDAQDLFRALWSAYSATPTNLKIIDLYVAFAVSTALIQVVYMALVGSFPFNSFLSGVLSCIGTAVLAVCLRIQVNKENKEFKDLAPERAFADFVLCNLVLHLVIMNFLG

SEQ ID NO: 5935 - protein, 115 aa, Cajanus cajan
MARSSSKDAQDLFRALWSAYAATPTNLKIIDLYVLFAVFTALIQVVYMALVGSFPFNSFLSGVLSCVGTAVLAVCLRIQVNKENKEFKDLAPERAFADFVLCNLVLHLVIMNFLG

SEQ ID NO: 5936 - protein, 115 aa, Populus trichocarpa
MARTTSRDAQALFQSLRSAYTATPTSLKIIDLYVVFAVFTAIIQVVYMAIVGSFPFNSFLSGVLSCVGTAVLAVCLRIQVNKENKEFKDLPPERAFADFVLCNLVLHLVIMNFLG

SEQ ID NO: 5937 - protein, 68 aa, Unknown
  Sequence found in Organisms: Cichorium intybus, Platanus occidentalis
MAIVGSFPFNSFLSGVLSCVGTAVLAVCLRIQVNKENKEFKDLPPERAFADFVLCNLVLHLVIMNFLG

SEQ ID NO: 5938 - protein, 326 aa, Lactuca sativa
MGCGNFFFTLTITFSVALITYNIIISANAPLRQELPGSSQGVLSVDPIIKMPGNRKSALADKKRMFHTAVTASDSVYNTWQTRIMYYWFKKMKENGGVNCEMGGFTRILHSGKADQFMDEIPTFVAQPLPAGTDQGYIVLNRPWAFVQWLQQVDIKEDYILMSEPDHVIVKPIPNLSKNGLGAAFPFFYIEPKKYEPILRKFYPEEKGPITNIDPIGNSPVIVGKESLKKIAPTWMNVSLAMKKDPEADKAFGWVLEMYAYAVSSALHDVGNILHKDFMLQPPWDTEIGEKFIIHYTYGCDYDMKGKLTYGKIGEWRFDKRSFDTI

SEQ ID NO: 5939 - protein, 117 aa, Centaurea maculosa
MGKSATTKDDAQALFQSLRSAYSATPTNLKIIDLYVVFAVFTALIQVVYMAIVGSFPFNSFLSGVLSCVGTAVLAVCLRIQVNKENKEFKDLPPERAFADFVLCNLVLHLVIMNFLG

SEQ ID NO: 5940 - protein, 114 aa, Senecio madagascariensis
DMMTKDDAQALFQSLRSAYSATPTNLKIIDLYVVFAVFTALIQVAYMAIVGSFPFNSFLSGVLSCVGTAVLAVCLRIQVNKENKEFKDLPPERAFADFVLCNLVLHLVIMNFLG

SEQ ID NO: 5941 - protein, 116 aa, Unknown
  Sequence found in Organisms: Solanum lycopersicum, Solanum phureja
MAKSSATKDAQALFHSLRSAYAATPTNLKIIDLYVIFAISTALIQVVYMAIVGSFPFNSFLSGVLSCIGTAVLAVCLRIQVNKENKEFKDLPPERAFADFVLCNLVLHLVIMNFLG

SEQ ID NO: 5942 - protein, 115 aa, Euonymus alatus
MARSTSKDAQDLLHTLRSAYAATPTSLKIIDIYVIFAVFTALIQVVYMAVVGSFPFNSFLSGVLSCVGTAVLAVCLRIQVNKENKEFKDLPPERAFADFVLCNLVLHLVIMNFLG

SEQ ID NO: 5943 - protein, 115 aa, Linum usitatissimum
MARSTVKDTQALFQSLRSAYAATPNNLKIIDLYVAFAVFTAVIQVVYMAVVGSFPFNSFLSGVLSCIGTAVLAVCLRIQVNKDNKDFKDLAPERAFADFVLCNLVLHLVIMNFLG

SEQ ID NO: 5944 - protein, 115 aa, Linum usitatissimum
MGRSTVKDTQALFQSLRSAYAATPNNLKIIDLYVAFAVFTAVIQVVYMAVVGSFPFNSFLSGVLSCIGTAVLAVCLRIQVNKDNKDFKDLAPERAFADFVLCNLVLHLVIMNFLG

SEQ ID NO: 5945 - protein, 115 aa, Phalaenopsis aphrodite
MAKPASNDILTLIRSLRSAYAATPTNLKIIDLYVIFAIATAFTQVVYMGIVGSFPFNSFLSGVLSCVGTAVLAVCLRIQVNKENKEFKDLPPERAFADFVLCNLVLHLVIMNFLG

SEQ ID NO: 5946 - protein, 115 aa, Plantago ovata
MARSTTKDAQALFRSLRSAYTATPTNLKIIDLYIVFAIATALVQVVYMALVGSFPFNSFLSGVLSCVGTAVLAVCLRIQVNKENKEFKDLPPERAFADFVLCNLVLHLVIMNFLG

SEQ ID NO: 5947 - protein, 115 aa, Brassica juncea
MAKSTSKDAQDLFRSLHSAYSATPTNLKIIDLYVVFSVFTALIQVAYKALVGSFPFNSFLSGVLSCIGTAVLAVCLRIQVNKENKEFKDLAPERAFADFVLCNLVLHLVIINFLG

SEQ ID NO: 5948 - protein, 115 aa, Unknown
  Sequence found in Organisms: Brassica napus, Brassica oleracea
MVKSTSKDAQDLFRSLHSAYSATPTNLKIIDMYVVFAVFTALIQVAYMALVGSFPFNSFLSGVLSCVGTAVLAVCLRIQVNKENKEFKDLAPERAFADFVLCNLVLHLVIINFLG

SEQ ID NO: 5949 - protein, 115 aa, Beta vulgaris
MAKSTTKDAQALLQSLRSAYAATPTNLKIIDLYVIFAISTALIQVVYMAVVGSFPFNSFLSGVLSCVGTAVLAVCLRIQVNKENKEFKDLAPERAFADFVLCNLVLHLVIMNFLG

SEQ ID NO: 5950 - protein, 115 aa, Citrus clementina
MARSTGKDAQALFHSLRSAYAATPTTLKIIDLYMGFAVFTALIQVVYMAIVGSFPFNSFLSEVLSCVGTAILAVCLRIQVNKDNKEFKDLPPERAFADFVLCNLVLHLVIMNFLG

SEQ ID NO: 5951 - protein, 115 aa, Vigna unguiculata
MARSSSKDAQDLFRALWSAYAATPTNLKIIDLYVMFAVFTALIQVVYIALVGSFPFNSFLSGVLSCVGTAVLAVCLRIQVNKENKEFKDLAPERAFADFVLCNLVLHLVIMNFLG

SEQ ID NO: 5952 - protein, 115 aa, Arachis hypogaea
MARSTSKDAQDLFRALWSAYSATPTNLKIIDLYVMYAVFTALIQVVYMALVGSFPFNSFLSGVLSCVGTAVLAVCLRIQVNKENKEFKDLAPERAFADFVLCNLVLHLVIMNFLG

SEQ ID NO: 5953 - protein, 133 aa, Cucurbita pepo
MARSTSKDAQALFQSLRSAYAATPTTLKIIDLYVIYAVFTALIQVAYMAIVGSFPFNSFLSGVLSCIGTAVLAVCLRIQVNKETRSSRIWPQSELLLICSVQPGSPFGDHLLPRIEHLILGSTSFLVFFGELI

SEQ ID NO: 5954 - protein, 136 aa, Cleome spinosa
AQDLFHSLRSAYSATPTNLKIIDLYVGFAVFTALIQVAYMALVGSFPFNSFLSGVLSCVGTAVLAVCLRIQVNKGKQGIQGLGTGEGICGFCPLQLGPPPSDHELPRLNQTFSQGNGTKERTVGRLDREKQLLSCI

SEQ ID NO: 5955 - protein, 119 aa, Prunus persica
MGKASTSSTTKDALVLFDSLRSAYSATPTTLKIIDLYVGFAVFTALIQVVYMALVGSFPFNSFLSGVLSCTGTAVLAVCLRIQVNKENKDFKDLPPERAFADFVLCNLVLHLVIMNFLG

SEQ ID NO: 5956 - protein, 113 aa, Heritiera littoralis
SSSKDDAQALFHSLRSAYAATPINLKIIDLYVGFAVFTALIQVVYMAIVGSFPFNSFLSGVLSCVGTAVLAVCLRIQVNKENKEFKDLPPERAFADFVLCNLVLHLVIMNFLG

SEQ ID NO: 5957 - protein, 117 aa, Bupleurum chinense
MGKSSATSKDAQLLFQSLRSAYAATPTNLKIIDLYVIFSVSTAVIQVVYMAIVGSFPFNSFLSGVLSCVGTAVLAVCLRIQVNKENKEFKDLPPERAFADFVLCNLVLHLVIMKFLG

SEQ ID NO: 5958 - protein, 117 aa, Unknown
  Sequence found in Organisms: Gossypium hirsutum, Gossypium raimondii
MGRTSSTKEDAGALFHSLRSAYAATPVNLKIIDLYVGFAIFTALIQVVYMAMVGSFPFNSFLSGVLSCVGTAVLAVCLRIQVNKENKEFKDLPPERAFADFVLCNLVLHLVIMNFLG

SEQ ID NO: 5959 - protein, 117 aa, Unknown
  Sequence found in Organisms: Gossypium hirsutum, Gossypium raimondii
MARTSSSKENAQALFHSLRSAYAATPVNLKIIDLYVGFAVFTALIQVVYMASVGSFPFNSFLSGVLSCVGTAVLAVCLRIQVNKENKEFKDLPPERAFADFVLCNLVLHLVIMNFLG

SEQ ID NO: 5960 - protein, 117 aa, Tragopogon dubius
MGKSPTTKDDAQALFQSLRSAYAATPTNLKIIDLYVVFAVFTALIQVVYMAIVGSFPFNSFLSGVLSCVGTAVLAVCLRIQVNKENKEFKDLPPERAFADFVLCNLVLHLVIMNFLG

SEQ ID NO: 5961 - protein, 116 aa, Olea europaea
MGRSTPSKDAQALFHSLHSAYAATPTNLKIIDLYILFAVFTAVIQVVYMAIVGSFPFNSFLSGVLSCVGTAVLAVCLRIQVNKENKEFKDLPPERAFADFVLCNLVLHLVIMNFLG

SEQ ID NO: 5962 - protein, 116 aa, Scabiosa columbaria
MGKSSTSKDAQALVQSLRSAYSATPTNLKIIDLYVLFAISTAVIQVVYMAVVGSFPFNSFLSGVLSCVGTAVLAVCLRIQVNKENKEFKDLPPERAFADFVLCNLVLHLVIMNFLG

SEQ ID NO: 5963 - protein, 116 aa, Valeriana officinalis
MVKSSTSKDAQALVQSLRSAYAATPTNLKIIDLYVIFAISTAVIQVVYMAVVGSFPFNSFLSGVLSCVGTAVLAVCLRIQVNKENKEFKDLPPERAFADFVLCNLVLHLVIMNFLG

SEQ ID NO: 5964 - protein, 116 aa, Solanum melongena
MAKSSATKDAQALFHSLRSAYAATPTNLKIIDLYVIFAISTALIQVVYMAIVGSFPFNSFLSGVLSCIGTAVLAVCLRIQVNKENKEFKDLPPERAFADFILCNLVLHLVIMNFLG

SEQ ID NO: 5965 - protein, 116 aa, Heritiera littoralis
MGRSSSKEDAQALFHSLRSAYAATPVNLKIIDLYVGFAVFTALIQVVYMAVVGSFPFNSFLSGVLSCVGTAVLAVCLRIQVNKENKEFKDLPPQRAFADFVLCNLVLHLVITNFLG

SEQ ID NO: 5966 - protein, 116 aa, Actinidia deliciosa
MGKSSTTKDAQALVHSLRSAYAATPTNLKIIDLYVMFAVFTALIQVVYMAIVGSFPFNSFLSGVLSCVGTAVLAVCLRIQVNKENKEFKDLPPERAFADFVLCNLVLHLVIMNFLG

SEQ ID NO: 5967 - protein, 116 aa, Actinidia deliciosa
MGKSATTKDAQALFHSLRSAYAATPTNLKIIDLYVMFAVVTALIQVVYMAIVGSFPFNSFLSGVLSCVGTAVLAVCLRIQVNKENKEFKDLPPERAFADFVLCNLVLHLVIMNFLG

SEQ ID NO: 5968 - protein, 116 aa, Petunia hybrida
MAKSSATKDAQALFHSLRSAYTATPTNLKIIDLYVIFAIFTALIQVVYMALVGSFPFNSFLSGVLSCVGTAVLAVCLRIQVNKENKEFKDLPPERAFADFVLCNLVLHLVIMNFLG

SEQ ID NO: 5969 - protein, 116 aa, Camellia sinensis
MVKSSTTKDAQALFHSLRSAYAATPTNLKIIDLYVMFAVFTALIQVVYMAIVGSFPFNSFLSGVLSCVGTAVLAVCLRIQVNKENKEFKDLPPERAFADFVLCNLVLHLVIMNFLG

SEQ ID NO: 5970 - protein, 127 aa, Tamarix hispida
  misc_feature (102)..(102): Xaa can be any naturally occurring amino acid
  misc_feature (108)..(108): Xaa can be any naturally occurring amino acid
  misc_feature (116)..(116): Xaa can be any naturally occurring amino acid
MARSTSKDAQALLHTLLSAYAATPTKLKIIDLYVAFSVATAIIQVLYMAVVGSFPFNSFLSGVLSCIGTAVLAVCLRIQVNKENKEFKDLPPERAFADFVLXNLVLHXVIMNFLGXTATSRAIECYL

SEQ ID NO: 5971 - protein, 115 aa, Amorphophallus konjac
MAKTTTSDARALIHSLYSAYSATPTNLKIIDLYVLFAVLSAAVQVVYMGIVGSFPFNSFLSGVLSCVGTAVLAVCLRIQVNKENKDFKDLPPERAFADFVLCNLVLHLVIMNFLG

SEQ ID NO: 5972 - protein, 115 aa, Amorphophallus konjac
MAKTTTSDTRALIHSLYSAYSATPTNLKIIDLYVIFAVLTAAVQVVYMGIVGSFPFNSFLSGVLSCVGTAVLAVCLRIQVNKENKDFKDLPPERAFADFVLCNLVLHLVIMNFLG

SEQ ID NO: 5973 - protein, 115 aa, Cannabis sativa
MARSTTKDAQALFQSLRSAYAATPTKLKVIDLYVVFAVMTAFVQVAYMAVVGSFPFNSFLSGVLSCVGTAVLAVCLRIQVNKENKEFKDLPAERAFADFVLCNLVLHLVIMNFLG

SEQ ID NO: 5974 - protein, 115 aa, Elaeis guineensis
MAKSTSSDAQMLIRSLRTAYAATPTNLKIIDLYVVYAIVTAVIQVVYMGVVGSFPFNSFLSGVLSCVGTAVLAVCLRIQVNKENKEFKDLPPERAYADFILCNLVLHLVIMNFLG

SEQ ID NO: 5975 - protein, 115 aa, Elaeis guineensis
MAKSTSSDAQMLIRSLRTAYAATPTNLKIIDVYVVYAIVTAVIQVVYMGVVGSFPFNSFLSGVLSCVGTAVLAVCLRIQVNKENKEFKDLPPERAYADFVLCNLVLHLVIMNFLG

SEQ ID NO: 5976 - protein, 115 aa, Musa acuminata
MAKSNTSDAKVLIRSLRSAYAATPISLKIIDLYVVYAITTAVIQVVYMGIVGSFPFNSFLSGVLSCVGTAVLAVCLRIQVNKEKKEFKDLPPERAFADFVLCNLVLHLVIMNFLG

SEQ ID NO: 5977 - protein, 115 aa, Lotus japonicus
MARSTTKDAQDLFRALWSAYSSTPTNLKIIDVYVAFAVFTALIQVAYVALVGSFPFNSFLSGVLSCIGTAVLAVCLRIQVNKENKEFKDLAPERAFADFVLCNLVLHLVIMNFLG

SEQ ID NO: 5978 - protein, 123 aa, Eschscholzia californica
RSTTTTTTTTSTTTKDAQALLNSLRSAYATTPTNLKIIDLYVVFAVLTALIQVVYMAIVGSFPFNSFLSGVLSCVGTAVLAVCLRIQVNKENKEFKDLAPERAFADFVLCNLVLHLVIMNFLG

SEQ ID NO: 5979 - protein, 156 aa, Sarracenia psittacina
IDVIASLLSGRLVRERIGPAMLSAVQSQMGAVEPSFEEIPNIFDTGGSKGLPDDSVEKIPKIKINSNNNVDASGEKASCSVCLQDFQLGETVRSLPHCHHMFHLPCIDRWLVRHGSCPLCRREAGNGEVIDDEGRSSAFPLAPFCLCHHTLEPQDH

SEQ ID NO: 5980 - protein, 124 aa, Fragaria vesca
MVKPPSSSSSSSSTTQDALALFNSLRSAYSATPTSLKVIDLYVGFAVSTAIIQVVYMALVGSFPFNSFLSGVLSCIGTAVLAVCLRIQVNKENKEFKDLAPERAFADFVLCNLVLHLVIMNFLG

SEQ ID NO: 5981 - protein, 119 aa, Triphysaria pusilla
MGRSATTATTKDAQAVFQSLRSAYVATPTNLKIIDLYIVFAVATAVIQVVYMALVGSFPFNSFLSGVLSCVGTAVLAVCLRIQVNKENKEFKDLPPERAFADFILCNLVLHLVIMNFLG

SEQ ID NO: 5982 - protein, 119 aa, Tabernaemontana elegans
MARSSSTKDADAIQALFHSLRSAYAATPTKLKIIDLYIIFAVVTALIQVVYMAIVGSFPFNSFLSGVLSCIGTAVLAVCLRIQVNKDNKEFKDLPPERAFADFVLCNLVLHLVIMNFLG

SEQ ID NO: 5983 - protein, 119 aa, Vinca minor
MARSSATKDSESFLALFHSLRSAYVATPTNLKIIDLYIIFAVVTAVIQVVYMGVVGSFPFNSFLSGVLSCIGTAVLAVCLRIQVNKDNKEFKDLPPERAFADFVLCNLVLHLVIMNFLG

SEQ ID NO: 5984 - protein, 117 aa, Flaveria ramosissima
MVKSPTTKDDAHALFHSLRSAYAATPTNLKIIDLYVVFAVSTALIQVVYMAIVGSFPFNSFLSGVLSCVGTAVLAVCLRIQVNKENKEFKDLPPERAFADFVLCNLVLHLVIMNFLG

SEQ ID NO: 5985 - protein, 117 aa, Flaveria ramosissima
MVRSPTTKDDAHALFHSLRSAYAATPTNLKIIDLYVVFAVSTALIQVVYMAIVGSFPFNSFLSGVLSCVGTAVLAVCLRIQVNKENKEFKDLPPERAFADFVLCNLVLHLVIMNFLG

SEQ ID NO: 5986 - protein, 116 aa, Flaveria ramosissima
GRSTTTKDDAQALFHSLRSAYSATPTNLKIIDLYVVFAVFTALIQVVYMAIVGSFPFNSFLSGVLSCVGTAVLAVCLRIQVNKENKEFKDLPPERAFADFVLCNLVLHLVIMNFLG

SEQ ID NO: 5987 - protein, 117 aa, Helianthus annuus
MVKSATTKDDAHALFHSLRSAYSATPTNLKIIDLYVVFAVFTALIQVVYMAIVGSFPFNSFLSGVLSCVGTAVLAVCLRIQVNKENKEFKDLPPERAFADFVLCNLVLHLVIMNFLG

SEQ ID NO: 5988 - protein, 117 aa, Taraxacum officinale
MGRSPTTKDDAQALFQSLRSAYAATPTNLKIIDLYVVFAVFTAVIQVVYMAVVGSFPFNSFLSGVLSCVGTAVLAVCLRIQVNKENKEFKDLPPERAFADFVLCNLVLHLVIMNFLG

SEQ ID NO: 5989 - protein, 117 aa, Helianthus annuus
MVKSATTKDDAHALFHSLRSAYSATPTNLKIIDLYVVFAVFTALIQVVYMAVVGSFPFNSFLSGVLSCVGTAVLAVCLRIQVNKENKEFKDLPPERAFADFVLCNLVLHLVIMNFLG

SEQ ID NO: 5990 - protein, 116 aa, Flaveria ramosissima
GRSPTTKDDAQALFHSLRSAYSATPTNLKIIDLYVVFAVFTALIQVVYMAIVGSFPFNSFLSGVLSCVGTAVLAVCLRIQVNKENKEFKDLPPERAFADFVLCNLVLHLVIMNFLG

SEQ ID NO: 5991 - protein, 116 aa, Fraxinus spp
MGRSTTSKDAQALFHSFYSAYAATPTNLKIIDLYMLFAVLTAVIQVVYMAIVGSFPFNSFLSGVLSCVGTAVLAVCLRIQVNKENKEFKDLPPERAFADFVLCNLVLHLVIMNFLG

SEQ ID NO: 5992 - protein, 116 aa, Lippia dulcis
MGRSATTKDAHALFHSLRSAYAATPNHLKIIDLYILFAVATAVIQVAYMAIVGSFPFNSFLSGVLSCVGTAVLAVSLRIQVNKDNKEFKDLPPERAFADFVLCNLVLHLVIINFLG

SEQ ID NO: 5993 - protein, 116 aa, Glycine max
MAPRSSSKDAQDLFRALWSAYAATPTNLKIIDLYVIYAVFTAFIQVVYMALVGSFPFNSFLSGVLSCVGTAVLAVCLRIQVNKENKEFKDLAPERAFADFVLCNLVLHLVIMNFLG

SEQ ID NO: 5994 - protein, 116 aa, Camellia sinensis
MGKSSTTKDAQALFQSLRSAYSATPTNLKIIDLYVMFAVFTALIQVVYMAVVGSFPFNSFLSGVLSCVGTAVLAICLRIQVNKENKEFKDLPPERAFADFVLCNLVLHLVIMNFLG

SEQ ID NO: 5995 - protein, 116 aa, Nicotiana tabacum
MAKSSATRDAQALFHSLRSAYAATPTNLKIIDLYVMFAIFTALIQVVYMAFVGSFPFNSFLSGVLSCIGTAVLAVCLRIQVNKENKEFKDLPPERAYADFILCNLVLHLVIMNFLG

SEQ ID NO: 5996 - protein, 68 aa, Quercus alba
MAIVGSFPFNSFLSGVLSCIGTAVLAVCLRIQVNKENKEFKDLPPERAFADFVLCNLVLHLVIMNFLG

SEQ ID NO: 5997 - protein, 120 aa, Carthamus tinctorius
  misc_feature (56)..(56): Xaa can be any naturally occurring amino acid
  misc_feature (65)..(65): Xaa can be any naturally occurring amino acid
MGKSPTTTKDDAQALFQSLRSAYSATPTNLKIIDLYVVFAVFTALIHGGLHSNSWXVSIQLFSLXCAFLCRDSRPSCLSSYSSEQRKQGIQGFTSGACICGFRSMQFGVAFGDYELPWIS

SEQ ID NO: 5998 - protein, 115 aa, Euphorbia peplus
MARSTTKDAQALFHSLRSSYAATPTTLKIIDLYVVFAVFTALIQIVYMAIVGSFPFNSFLSGLLSCVGTAVLAVCLRIQVNKENKEFKDLPPERAFADFVLCNLVLHLVIMNFLG

SEQ ID NO: 5999 - protein, 115 aa, Antirrhinum majus
MGRSTTKDAQALLHTLRSAYVATPTNLKIIDLYIVFAVVTALIQVVYMAAVGTFPFNSFLSGVLSCVGTAVLAVSLRIQVNKDNKEFKDLPPERAFADFVLCNLVLHLVIMNFLG

SEQ ID NO: 6000 - protein, 115 aa, Cleome gynandra
MARSTSKDAQDLFHSLRSAYSATPTNLKIIDLYVVFSVFTALIQIAYMAFVGTFPFNSFLSGVLSCVGTAVLAVCLRIQVNKENKEFKDLPSERAFADFILCNLVLHLVIMNFLG

SEQ ID NO: 6001 - protein, 115 aa, Zingiber officinale
MVKSSTSDAQALIRSLRSAYAATPTKLKIIDLYVVYAIATAVIQVAYMGIVGSFPFNSFLAGVLSCVGTAVLAVCLRIQVNKENKEFKDLPAERAFADFVLCNLVLHLVVMNFLG

SEQ ID NO: 6002 - protein, 115 aa, Vitis vinifera
MARSTTKDAQALFHSLRSAYSATPTNLKIIDLYVIFAVLTAIIQVGYMAIVGSFPFNSFLSGVLSCVGTAVLAVCLRIQVNKENKEFKDLPPERAFADFVLCNLVLHLVIINFMG

SEQ ID NO: 6003 - protein, 127 aa, Silene vulgaris
VSSQGKESTQQIGEINKDKDAQALFHSLRSAYAATPINLKIIDLYIIFAVSTALIQVAYMATVGSFPFNSFLSGVLSCVGTAVLAVCLRIQVNKENKEFKDLAPERAFADFVLCNLVLHLVIMNFLG

SEQ ID NO: 6004 - protein, 119 aa, Prunus persica
MGKASTSSTTKDALALFSSLRSAYSATPITLKIIDLYVAFAVSTALIQVVYMAIVGSFPFNSFLSGVLSCTGTAVLAVCLRIQVNKENKEFKDLPPERAFADFVLCNLVLHLVIMNFLG

SEQ ID NO: 6005 - protein, 121 aa, Glycine max
MGGSSSSSSSSSKDAQDLFRALWSAYASTPTNLKIIDLYVIYAVFTALIQVVYMALVGSFPFNSFLSGVLSCVGTAVLAVCLRIQVNKDNKEFKDLAPERAFADFVLCNLVLHLVIMNFLG

SEQ ID NO: 6006 - protein, 118 aa, Cirsium arvense
MGKPPATTKDDAQALFHSLRSAYSATPTNLKLIDLYVVFAVFTALIQVGYMAIVGSFPFNSFLSGVLSCVGTAVLAVCLRIQVNKENKEFKDLPPERAFADFVLCNLVLHLVIMNFLG

SEQ ID NO: 6007 - protein, 118 aa, Lactuca sativa
MGKSTATTKDDAQALFRSLHSAYSATPTNLKIIDLYVVFAVFTALIQVGYMAIVGSFPFNSFLSGVLSCVGTAVLAVCLRIQVNKENKEFKDLPPERAFADFVLCNLVLHLVIMNFLG

SEQ ID NO: 6008 - protein, 118 aa, Helianthus annuus
MGKSTVTTKDDAHALFHSLRSAYSATPTNLKIIDLYVMFAVFTALIQVGYMAIVGSFPFNSFLSGVLSCVGTAVLAVCLRIQVNKENKEFKDLPPERAFADFVLCNLVLHLVIMNFLG

SEQ ID NO: 6009 - protein, 117 aa, Arnica chamissonis
MVRSPATKDDAHALFHSLRSAYSATPTNLKIIDLYVVFAVFTALIQVVYMAIVGSFPFNSFLSGVLSCVGTAVLAVCLRIQVNKENKEFKDLPPERAFADFVLCNLVLHLVIMNFLG

SEQ ID NO: 6010 - protein, 117 aa, Unknown
  Sequence found in Organisms: Cirsium arvense, Cynara scolymus
MGKSPTTKDDAQALFQSLRSAYSATPTNLKIIDLYVVFAVFTALVQVVYMAIVGSFPFNSFLSGVLSCVGTAVLAVCLRIQVNKENKEFKDLPPERAFADFVLCNLVLHLVIMNFLG

SEQ ID NO: 6011 - protein, 117 aa, Cirsium arvense
MGKSATTKADAQALFQSLRSAYSATPTNLKIIDLYVVFAVFTALIQVVYMAIVGSFPFNSFLSGVLSCVGTAVLAVCLRIQVNKENKEFKDLPPERAFADFVLCNLVLHLVIMNFLG

SEQ ID NO: 6012 - protein, 117 aa, Flaveria ramosissima
MGKSPTTKDDAQALFHSLRSAYSATPTNLKIIDLYVVFAVFTALIQVVYMAIVGSFPFNSFLSGVLSCVGTAVLAVCLRIQVNKENKEFKDLPPERAFADFVLCNLVLHLVIMNFLG

SEQ ID NO: 6013 - protein, 117 aa, Flaveria ramosissima
MGRSPTTKDDAQALFHSLRSAYSATPTNLKIIDLYVVFAVFTALIQVVYMAIVGSFPFNSFLSGVLSCVGTAVLAVCLRIQVNKENKEFKDLPPERAFADFVLCNLVLHLVIMNFLG

SEQ ID NO: 6014 - protein, 117 aa, Flaveria ramosissima
MVRSPTTKDDAHALFHSLRSAYSATPTNLKIIDLYVVFAVSTALIQVVYMAIVGSFPFNSFLSGVLSCVGTAVLAVCLRIQVNKENKEFKDLPPERAFADFVLCNLVLHLVIMNFLG

SEQ ID NO: 6015 - protein, 117 aa, Helianthus annuus
MVKSATTKDDAHALFHSLRSAYSATPTNLKIIDLYVVFAVFTALIQVVYMAIVGSFPFNSFLSGVLSCVGTAVLAVCLRIQVNKENKEFKDLPPERAFADFVLCNLVLHLVIINFLG

SEQ ID NO: 6016 - protein, 117 aa, Utricularia gibba
MGRSTTTKDAEALVHSLRSAYSATPTNLKIIDLYIAFAVVTALIQVVYMAVVGSFPFNSFLSGVLSCVGTAVLAACLRIQVNKENKEEFKDLPPERAFADFVLCNLVLHLVIMNFLG

SEQ ID NO: 6017 - protein, 119 aa, Artemisia annua
MVKPTAATTKDDAQALFKSLRSAYSATPTNLKIIDLYVAFAVFTAVIQVGYMAIVGSFPFNSFLSGVLSCVGTAVLAVCLRIQVNKENKEFKDLPPERAFADFVLCNLVLHLVIMNFLG

SEQ ID NO: 6018 - protein, 117 aa, Panax ginseng
MGKSSSTSNDAQALFQSLRSAYAATPPNLKIIDLYVIFAVSTALIQVVYMAIVGSFPFNSFLSGVLSCVGTAVLAVCLRIQVNKENKEFKDLPPERAFADFVLCNLVLHLVIMNFLG

SEQ ID NO: 6019 - protein, 117 aa, Helianthus annuus
MVKSATTKDDAHALFHSLRSAYSVTPTNLKIIDLYVVFAVFTALIQVVYMAIVGSFPFNSFLSGVLSCVGTAVLAVCLRIQVNKENKEFKDLPPERAFADFVLCNLVLHLVIMNFLG

SEQ ID NO: 6020 - protein, 117 aa, Helianthus annuus
MAKSPTTKDDAQALFYSLRSAYSATPTNLKIIDLYVVFAVFTALIQVVYMAIVGSFPFNSFLSGVLSCVGTAVLAVCLRIQVNKENKEFKDLPPERAFADFVLCNLVLHLVIMNFLG

SEQ ID NO: 6021 - protein, 114 aa, Euphorbia peplus
RATTSKDAQALLHSLRSSYAATPTTLKIIDLYVLFAISTAVIQVVYMAIVGSFPFNSFLSGVLSCVGTAVLAVCLRIQVNKENKEFKDLPPERAFADFVLCNLVLHLVIMNFLG

SEQ ID NO: 6022 - protein, 116 aa, Olea europaea
MGRTTTSKDAQALFHSLRSAYVATPTNLKIIDLYIMFAVVTAVIQVVYMAIVGSFPFNSFLSGVLSCVGTAVLAVCLRIQVNKENREFKDLPPERAFADFVLCNLVLHLVIMNFLG

SEQ ID NO: 6023 - protein, 116 aa, Lippia dulcis
MARSGTTKDAQALLHSLRLAYAATPTNLKIIDLYIVFAVLTAVIQVVYMAIVGTFPFNSFLSGVLSCVGTAVLAVSLRIQVNKENKEFKDLPPERAFADFVLCNLVLHLVIMNFLG

SEQ ID NO: 6024 - protein, 116 aa, Ipomoea nil
MARSSTGKDAQALFHSLRSAYAATPTNLKIIDLYVMFALFTAVIQVVYMAIVGSFPFNSFLSGVLSCIGTAVLAVCLRIQVNKENKEFKDLPPERAYADFVLCNLVLHLVIINFLG

SEQ ID NO: 6025 - protein, 116 aa, Salvia sclarea
MGRSATTKDAHALFHSLRSAYAATPNQLKIIDLYILFAVVTAVIQVAYMAIVGSFPFNSFLSGVLSCVGTAVLAVSLRIQVNKDNKEFKDLPPERAFADFVLCNLVLHLVIVNFLG

SEQ ID NO: 6026 - protein, 116 aa, Salvia sclarea
MGRSAATKDAQALFHSLRSAYAATPNNLKIIDLYILFAVVTAVIQVGYIAIVGSFPFNSFLSGVLSCVGTAVLAVSLRIQVNKDNKEFKDLPPERAFADFVFCNLVLHLVIMNFLG

SEQ ID NO: 6027 - protein, 116 aa, Sesamum indicum
MGRSATTKDAQALFHSLRSAYAATPNNLKIIDLYIVFAVVTAVIQVVYMAIVGSFPFNSFLSGVLSCVGTAVLAVSLRIQVNKENKEFKDLPPERAFADFVLCNLVLHLVIMNFLG

SEQ ID NO: 6028 - protein, 115 aa, Zingiber officinale
MAKSSSNDAQALIRSLRSAYAATPTNLKIIDLYVVYAITTAVIQIVYMGIVGSFPFNSFLSGILSCVGTAVLAVCLRIQVNKENKEFKDLSPERAFADFVLCNLVLHLVIMNFLG

SEQ ID NO: 6029 - protein, 115 aa, Triphysaria pusilla
GKPATTKDAQALFQSLRSAYAATPANLKIIDIYIVFAVVTALIQVAYMAIVGSFPFNSFLSGVLSCVGTAVLAVSLRIQVNKENKEFKDLPPERAFADFILSNLVLHLVIMNFLG

SEQ ID NO: 6030 - protein, 79 aa, Acacia harpophylla
MAKSTSKDAQDLLRALWSAYSATPTNLKIIDLYVMFAVFTALIQVVYMALVGHSHSTPSFQEYFLALGLQFLLFVSGSK

SEQ ID NO: 6031 - protein, 120 aa, Catharanthus roseus
MARSSSSTKDGESFLALFHSLRSAYAATPTNLKIIDLYIIFAVLTALIQVVYMGIVGSFPFNSFLSGVLSCIGTAVLAVCLRIQVNKDNKEFKDLPSERAFADFLLCNLVLHLVIMNFLG

SEQ ID NO: 6032 - protein, 119 aa, Ambrosia trifida
MAKSTTTTTKDDAHALFHSLRSAYSATPTNLKIIDLYVVFAVFTALIQVVYMAIVGSFPFNSFLSGVLSCVGTAVLAVCLRIQVNKENKEFKDLPPERAFADFVLCNLVLHLVIMNFLG

SEQ ID NO: 6033 - protein, 116 aa, Lippia dulcis
MGKSATTRDVHALFHSLRSAYAATANHLKIIDLYIFFAIATALIQVAYMAIVGSFPFNSFLSGVLSCVGTAVLAVSLRIQVNKDNKEFKDLPPERAFADFVLCNLVLHLVIMNFLG

SEQ ID NO: 6034 - protein, 119 aa, Persea americana
MAKSSSSSTAKDAQALIQSLRSAYSATPTNLKIIDLYVMFAIFTGLIQVVYMALVGSFPFNSFLSGVLSCIGTAVLAVCLRIQVNKENKEFKDLPPERAFADFVLCNLVLHLVIMNFLG

SEQ ID NO: 6035 - protein, 116 aa, Nicotiana tabacum
MAKSSATKDAQALLHSLRSAYASTPTNLKIIDIYVLFAIFTAVIQVGYMAIVGSFPFNSFLSGVLSCVGTAVLAVCLRIQVNKENKEFKDLPPERAYADFVLCNLVLHLVIMNFLG

SEQ ID NO: 6036 - protein, 116 aa, Triphysaria pusilla
MGKPATTRDAQALLHSLRSAYAATPANLKIIDIYIVFAVVTALIQVVYMAMVGSFPFNSFLSGVLSCVGTAVLAVSLRIQVNKENKEFKDLPPERAFADFILCNLVLHLVIMNFLG

SEQ ID NO: 6037 - protein, 121 aa, Rosa hybrid cultivar
MVRPSSSSSSTSQDALALFNSLRSAYSATPTALKIIDLYVGFAVSTAIIQVVYMALVGSFPFNSFLSGVLSCIGTAVLAVCLRIQVNKENKEFKDLAPERAFADFVLCNLVLHLVIMNFLG

SEQ ID NO: 6038 - protein, 121 aa, Rosa hybrid cultivar
MVKPSSSSSSTSQDALALFNSLRSAYSATPTALKIIDLYVGFAVSTAIIQVVYMALVGSFPFNSFLSGVLSCIGTAVLAVCLRIQVNKENKEFKDLAPERAFADFVLCNLVLHLVIMNFLG

SEQ ID NO: 6039 - protein, 69 aa, Ambrosia trifida
MAKSTTTTKDDAHALFHSLRSAYSATPTNLKIIDLYVLFAVFTALIQVVSWQLLDRFHSTLSSQACFLV

SEQ ID NO: 6040 - protein, 118 aa, Cichorium intybus
MGKSTATTKDDAQALFRSLHSAYSTTPTNLKIIDLYVVFAVVTALIQVVYMAIVGSFPFNSFLSGVLSCVGTAVLAVCLRIQVNKENKEFKDLPPERAFADFVLCNLVLHLVIMNFLG

SEQ ID NO: 6041 - protein, 118 aa, Cynara scolymus
MGRSPATTKDDAQALFHSLRSAYSATPTNLKLIDLYVVFAVFTALIQVGYMAIVGSFPFNSFLSGVLSCVGTAVLAVCLRIQVNKENKEFKDLPPERAFADFVLCNLVLHLVIMNFLG

SEQ ID NO: 6042 - protein, 118 aa, Taraxacum officinale
MGKSTATTKDDAQALFRSLHSAYSATPTNLKIIDLYVVFAVFTALIQVGYMAIVGSFPFNSFLSGVLSCVGTAVLAVCLRIQVNKENKEFKDLPPERAFADFVLCNLVLHLAIMNFLG

SEQ ID NO: 6043 - protein, 122 aa, Aquilegia formosa
MVRSSTSSSTSTKEDAQALIQSLGSAYAVTPTNLKIIDLYVMFAILTALIQVVYMAIVGSFPFNSFLSGVLSCVGTAVLAVCLRIQVNKENKEFKDLPPERAFADFVLCNLVLHLVIMNFLG

SEQ ID NO: 6044 - protein, 117 aa, Helianthus annuus
MAKSPTTKDDAQALFHSLRSAYSATPTNLKIIDLYVVFAVFTALIQVVYMAIVGSFPFNSFLSGVLSCVGTAVLAICLRIQVNKENKEFKDLPPERAFADFVLCNLVLHLVIMNFLG

SEQ ID NO: 6045 - protein, 117 aa, Gerbera hybrid cultivar
MGKSSTAKDDAQALFHSLRSAYSATPTNLKIIDLYVVFAVSTAIIQVVYMAIVGSFPFNSFLSGVLSCVGTAVLAVCLRIQVNKENKEFKDLPPERAFADFVLCNLVLHLVIMNFLG

SEQ ID NO: 6046 - protein, 117 aa, Helianthus annuus
MAKSPTTKDDAQALFHSLRSAYSATPTNLKIIDLYVVFVVFTALIQVVYMAIVGSFPFNSFLSGVLSCVGTAVLAVCLRIQVNKENKEFKDLPPERAFADFVLCNLVLHLVIMNFLG

SEQ ID NO: 6047 - protein, 116 aa, Sarracenia psittacina
MGKSSTTKDAQALFHSLRSAYVATPTNLKIIDLYVIFAAVTALIQVVYMAIVGSFPFNSFLSGILSCVGTAVLAVCLRIQVNKENKEFKDLPPERAFADFVLCNLVLHLVIMNFLG

SEQ ID NO: 6048 - protein, 121 aa, Amborella trichopoda
MARSSSSSSSTAKDAQALIQSLRSAYAATPTNLKLIDLYVVFAVLTALIQVVYMAIVGSFPFNSFLSGVLSCVGTAVIAVCLRIQVNKENKEFKDLAPERAFADFVLCNLVLHLVIMNFLG

SEQ ID NO: 6049 - protein, 115 aa, Medicago truncatula
MVKSTAKDAQDLIRTLWSAYSATPTNLKIIDHYVVFAVFTALIQVVYMALVGTFPFNSFLSGVLSCVGTAVLAVCLRIQVNKENKEFKDIAPERAFADFVLCNVVLHLVIMNFLG

SEQ ID NO: 6050 - protein, 115 aa, Tamarix hispida
MVKSTTKDAQALIQSLLSAYAVTPTNLKIIDLYVAFAISTALIQILYVAIVGSFPFNSFLSGVLSCVGTAVLAVCLRIQVNKENKEFKDLPPERAYADFALCNLVLHLVIMNFLG

SEQ ID NO: 6051 - protein, 783 aa, Sorghum bicolor
MDAEAGVAGADQLPRRQYYMNLLLLAYQSFGVVYGDLSTSPLYVYKSTFSGKLSQYQDEETVFGVLSLIFWTFTLIPLLKYVTIVLSADDNGEGGPFALYSLLCRHAKLSLLPNQQAADEELSSYYRNGFAPRNGSSPWLKRFLEKHKKMRTVLLLIVLCGASMVIGDGVLTPAISVLSSMSGLQVRATGLEHSSVVLLSCIVLVGLFALQHRGTQKVAFMFAPIVIIWLLSIGGIGLYNIFHWNPNIYQALSPYYMVKFFRKTGKDGWIALGGILLSMTGSEAMFADLGHFTSASVRVAFITVIYPCLILQYMGHAAFLSKNTFHMPTSFYDTIPEPVFWPVFVVATLAAVVGSQAVISATFSIVKQCHALGCFPRVKVVHTSRWIYGQIYIPEINWILMVLCVAVTIAFRDTTLIGNAYGVACMTVMLVTTFLMALIIIFVWQRNIIFALVFLVFFGSIEAVYLSSSLMKVPQGGWVPLVLAFIFMSVMYIWHYGLRRKYQFDLQNKVSMRSILSLGPSLGIVRVPGIGLIYTELVTGVPSIFSHFVTNLPAFHEVLVFLCVKSVPVPYVSQDERYLVGRIGPKEYRMYRCIVRYGYKDVQRDDDNFENMLVMSIAKFIMMEAEDASSSASYDIANEGRMAVITTTDASGSPLAMRDFNGLADSMTTRSSKSESLRSLQSSYEQESPSVSRRRRVRFEVPEEDDMGQQVKEELMALVEAKHAGVAYIMGHSYIKARRSSSFLKKFAIDVGYSFLRKNCRGPSVTLHIPHISLIEVGMIYYV

SEQ ID NO: 6052 - protein, 783 aa, Setaria italica
MDAEAGVVGADQLPRRQYYMNLLLLAYQSFGVVYGDLSTSPLYVYKSTFSGKLRQYQDEETVFGVLSLIFWTFTLIPLLKYVTIVLSADDNGEGGPFALYSLLCRHAKLSLLPNQQAADEELSSYYRNGFAPRNGSAPWLRRFLEKHKKVRTVLLLVVLCGASMVIGDGVLTPAISVLSSMSGLQVRATGLEHRSVVLLSCIVLVGLFALQHRGTQKVAFMFAPIVIIWLFSIGGIGLYNILHWNPNIYQALSPYYMVKFFRKTGKDGWISLGGILLSMTGSEAMFADLGHFTSASVRVAFVTVIYPCLILQYMGHAAFLSKNTFHMPTGFYDTIPEPVFWPVFVVATLAAVVGSQAVISATFSIVKQCHALGCFPRVKVVHTSRWIYGQIYIPEINWILMVLCVAVTVSFRDTTLIGNAYGIACMTVMLVTTFLMALIVIFVWQRNIIFALIFLVFFGSIEAVYLSSSLMKVPQGGWVPLVLAFIFMSVMYIWHYGLRRKYQFDLQNKVSMRSILSLGPSLGIVRVPGIGLIYTELVTGVPSIFSHFVTNLPAFHEVLVFLCVKSVPVPYVSPDERYLVGRIGPKEYRMYRCIVRYGYKDVQRDDDNFENMLVMGIAKFIMMEAEDASSSASYDIANEGRMAVITTTDDAGTPLTMRDFNGLADSMTTRSSKSESLRSLQSSYEQESPNVSRRRRVRFEVPEDDDMGQQVKDELMALVEAKHAGVAYIMGHSYIKARRSSSFLKKFAIDVGYSFLRKNCRGPSVTLHIPHISLIEVGMIYHV

SEQ ID NO: 6053 - protein, 783 aa, Pennisetum glaucum
MDAEAGVVGADQMPRRRYYMNLLLLAYQSFGVVYGDPSTSPLYVYKSTFSGKLRQYQDEETVFGVLSLIFWTFTLIPLLKYVTIVLSADDNGEGGPFALYSLLCRHAKLSLLPNQQAADEELSSYYRNGFAPRNGSAPWLRRFLEKHKKVRTVLLLVVLCGASMVIGDGVLTPAISVLSSMSGLQVRATGLEHRSVVLLSCIVLVGLFALQHRGTQKVAFVFAPIVIIWLFSIGGIGLYNILHWNPNIYQALSPYYMVKFFKKTGKDGWISLGGILLSMTGSEAMFADLGHFTSASVRVAFVTVVYPCLVLQYMGHAAFLSKNTFHMPTGFYDTIPEPVFWPVFVVATLAAVVGSQAVISATFSIVKQCQALGCFPRVKVVHTSRWIYGQIYIPEINWILMVLCVAVTVSFRDTTLIGNAYGIACMTVMLVTTFLMALIVIFVWQRNMIFALIFLVFFGSIEAVYLSSSLMKVPQGGWVPLVLAFIFMSVMYIWHYGLRRKYQFDLQNKVSMRSILSLGPSLGIVRVPGIGLIYTELVTGVPSIFSHFVTNLPAFHEVLVFLCVKSVPVPYVSPDERYLVGRIGPKEYRMYRCIVRYGYKDVQRDDDNFENMLVMSIAKFIMMEAEDASSSASYDIANEGRMAVITTADDAGTPLTMRDFNALADSMTTRSSKSESLRSLQSSYEQESPNVSRRRRVRFEVPEDDDMGQQVKDELMALVEAKHAGVAYIMGHSYIKARRSSSFLKKFAIDVGYSFLRKNCRGPSVTLHIPHISLIEVGMIYYV

SEQ ID NO: 6054 - protein, 784 aa, Brachypodium distachyon
MDAEAGAAGADQLPWRQRYRNLLLLAYQSFGVVYGDLSTSPLYVYKSAFSGRLSRYQDEQTVFGVLSLIFWTFTLVPLLKYVIIVLSADDNGEGGPFALYSLLCRHAKLSLLPNQQAADEELSTYYRDGFAAQHGSTPWLRRFLEKHKTIKTVLLLVVLCGASMVIGDGVLTPAISVLSSMSGLQVRATGLQDRSVVLLSCIVLVGLFSLQHRGTQKVAFMFAPIVIIWLFCIGGIGLYNIVHWNPRIYQALSPYYIVKFFQTTGTDGWIALGGILLSMTGSEAMFADLGHFTSASVRLAFITIIYPCLTLQYMGQAAFLSKNMFHMRTSFYDSIPGPVFWPVFVVATLAAVVGSQAVISATFSIVKQCHALGCFPRVKVVHTSRWIYGQIYIPEINWILMVLCVAVTVAFRDTTLIGNAYGIACMTVMLVTTFLMALIIIFVWQKNIIFALLFLFFFGSIETVYLSSSLMKVHQGGWVPLVLAFIFMSVMFIWHFGTRRKYQFDLQNKVSMRSILSLGPNLGIVRVPGIGLIYTELVTGVPAIFTHFVTNLPAFHEVLVFLCVKSVPVPYVPPDERYLVGRIGPRAYRMYRCIVRYGYKDVQRDDENFENMLVMSIAKFIMMEAEDVSSSASYDMANEGRMAVIRTTDDAGTPLGMRDLSGLAESISTTRSSKSESLRSLQSSYEQESPSVSRRRRVRFELPDEDNMDQQVKDELLALVEAKHAGVAYIMGHSYIKARRSSSFLKKFAIDVGYSFLRKNCRGPSVSLHIPHISLIEVGMIYYV

SEQ ID NO: 6055 - protein, 282 aa, Brachypodium distachyon
MDAEAGAAGADQLPWRQRYRNLLLLAYQSFGVVYGDLSTSPLYVYKSAFSGRLSRYQDEQTVFGVLSLIFWTFTLVPLLKYVIIVLSADDNGEGGPFALYSLLCRHAKLSLLPNQQAADEELSTYYRDGFAAQHGSTPWLRRFLEKHKTIKTVLLLVVLCGASMVIGDGVLTPAISVLSSMSGLQVRATGLQDRSVVLLSCIVLVGLFSLQHRGTQKVAFMFAPIVIIWLFCIGGIGLYNIVHWNPRIYQALSPYYIVKFFQTTGTDGWIALGGILLSMTGK

SEQ ID NO: 6056 - protein, 783 aa, Oryza sativa
MDAEAGVGGADQLPWRQHYRNLLLLAYQSFGVVYGDLSTSPLYVYKSTFSGRLRRYQDEQTVFGVLSLIFWTFTLIPLLKYVTIVLSADDNGEGGPFALYSLLCRHAKLSFLPNQQSADEELSTYYRNGFTSRHGSLPWLRRFMEKHKNARTVLLLIVLCGASMMIGDGILTPAISVLSSMSGLKVRATGLHDRSVVLLSCIVLVGLFALQHRGTQKVAFMFAPIVVIWLFCIGGIGLYNIIHWNPRIYQALSPYYIVKFFRTTGKDGWIALGGILLSMTGCEAMFADLGHFTSASVRLAFITIIYPCLILQYMGQAAFLSKNILDMPTGFYDSIPGPIFWPVFVVATLAAVVGSQAVISATFSIVKQCHSLGCFPRVKVVHTSRWIYGQIYIPEINWILMVLCVAVTVAFRDITLIGNAYGVACMTVMFVTTFLMALIMIFVWQKNIIFALSFFLLFGSVEVVYLSSSLMKVTQGGWVPLVLALIFMSVMYIWHYGTRKKYQYDLQNKVSMRYILSLGPSLDVVRVPGIGLIYTELVTGVPNIFTHFTTNLPAFHEVLVFLCVKSVPVPYVSPDERYLVGRIGPRAYRMYRCIVRYGYKDVQRDDDNFENMLVMNIGKFIMMEAEDASSSASYDTANEGRMAVITTSDDYDSPLAVRDSNDLADSMTMRSTKSESLRSLQSSYEQESPNVSRRRRVRFELPEEDDMDQQVKDELLALVEAKHTGVTYVMGHVYIKARKNSSFFKRFAIDVGYSFLRKNCRGPSVTLHIPHISLIEVGMAYQV

SEQ ID NO: 6057 - protein, 621 aa, Sorghum bicolor
MFGRDPWGGPLEISNADSATDDDRSRDLDRAALMRQLDETQQSWLLAGPGDQAGKKKKKYVDLGCVVVDRKIFMWTVGTILGLGVFIGFIMMIVKLVPHKRPPPPPPDQYTQALHKALMFFNAQRSGPLPKHNGVSWRGNSCMKDGLSDSTVRRSLVGGYYDAGDAIKFNYPMAWSMTMLSWSVIEYRAKYEAIGELDHIKELIKWGTDYILKTFNSSADTIDRIVAQVGVGDTSKGGSQPNDHYCWMRPEDIDYKRPVTECHSCSDLASEMAAALAAASIVFKDSKTYSDKLVKGAKALYKFGRLQRGRYSPNGSDQAIFYNSTSYWDEFVWGGAWMYFATGNNSYLTVATAPGMAKHAGAYWFGSPNYGVFTWDDKLPGAQVLLSRLRLFLSPGYPYEEILRTFHNQTDNVMCSYLPLFNSFNFTKGGLIQLNHGRPQPLQYAVNAAFLASLYSDYLEAADTPGWYCGPNFYTTEVLRKFARSQLDYILGKNPLKMSYVVGFGNKYPKRPHHRGASIPHNGVKYGCKGGYKWRDTKKANPNILVGAMVAGPDRHDGYKDVRTNYNYSEPTLAANAGLVAALISISDIKTGRFGIDKNTIFSAIPPMFPTPPPPPSAWKP

SEQ ID NO: 6058 - protein, 621 aa, Zea mays
MFGRDPWGGPLEISNADSATDDDRSRDLDRAALMRQLDETQQSWLLAGPGDQAGKKKKRYVDLGCLVVDRKVFMWTVGTVLGLGVFIGFVIMIVKLVPHKRPPPPPPDQYTQALHKALMFFNAQRSGPLPKHNGVSWRGNSCMKDGLSDSTVRRSLVGGFYDAGDAIKFNYPMAWSMTMLSWSVIEYRAKYEAIGELDHIRELIKWGTDYILKTFNSSADTIDRIVAQVGVGDTSKGSSQPNDHYCWMRPEDIDYKRPVTECHSCSDLASEMAAALAAASIVFKNSKTYSDKLVKGAKALYKFGRLQRGRYSPNGSDQAIFYNSTSYWDEFVWGGAWMYFATGNNSYLTVATAPGMAKHAGAYWFGSPNYGVFTWDDKLPGAQVLLSRLRLFLSPGYPYEEILRTFHNQTDNVMCSYLPVFNSFNFTKGGLIQLNHGRPQPLQYAVNAAFLASLYSDYLEAADTPGWYCGPNFYTIEVLRKFARSQLDYILGKNPLKMSYVVGFGNKYPKRPHHRGASIPHNGVKYGCKGGYKWRDTKKANPNILVGAMVAGPDRRDGYKDVRTNYNYTEPTLAANAGLVAALISISDIKTGRFGIDKNTIFSAIPPMFPTPPPPPSAWKP

SEQ ID NO: 6059 - protein, 621 aa, Panicum virgatum
MFGRDPWGGPLEISNADSATDDDRSRDLDRAALMRQLDETQQSWLLAGPGDQAGKKKKKYVDLGCVVLDRKIFMWTVGTILGLGVFIGFIMMIVKLVPHKRPPPPPPDQYTQALHKALMFFNAQRSGPLPKHNGVSWRGNSCMKDGLSDSTVRRSLVGGFYDAGDAIKFNYPMAWSMTMLSWSVIEYKAKYEAIGELDHIKELIKWGTDYILKTFNSSADTIDRIVAQVGLGDTSKGSSQPNDHYCWMRPEDIDYKRPVTECHSCSDLASEMAAALAAASIVFKDSKTYSDKLVKGAKALYKFGRLQRGRYSPNGSDQAIFYNSTSYWDEFVWGGAWMYFATGNNSYLTIATAPGMAKHAGAYWFGSPNYGVFTWDDKLPGAQVLLSRLRLFLSPGYPYEEILRTFHNQTDNVMCSYLPLFNSFNFTKGGLIQLNHGGPQPLQYAVNAAFLASLYSDYLEAADTPGWYCGPNFYTTEVLRKFARSQLNYILGKNPLKMSYVVGFGNKYPKRPHHRGASIPHNGVKYGCKGGFKWRETKKANPNVLVGAMVAGPDRHDGFKDVRTNYNYTEPTLAANAGLVAALISIADIPTGRYSIDKNTIFSAIPPMFPTPPPPPSAWKP

SEQ ID NO: 6060 - protein, 621 aa, Pennisetum glaucum
MFGRDPWGGPLEISNADSATDDDRSRDLDRAALMRQLDETQQSWLLAGPGDQAGKKKKKYVDLGCVVLDRKIFMWTVGTILGLGVFIGFIMMIVKLVPHKHPPPPPPDQYTQALHKALMFFNAQRSGPLPKHNGVSWRGNSCMKDGLSDSTTRRSLVGGFYDAGDAIKFNYPMAWSMTMLSWSVIEYKAKYEAIGELDHIKELIKWGTDYILKTFNSSADTIDRIVAQVGVGDTSKGGSQPNDHYCWMRPEDIDYKRPVTECHSCSDLASEMAAALAAASIVFKDSKTYSDKLVKGAKALYKFGRTQRGRYSPNGSDQAIFYNSTSYWDEFVWGGAWMYFATGNNSYLTVATAPGMAKHAGAYWFGSPNYGVFTWDDKLPGAQVLLSRLRLFLSPGYPYEEILRTFHNQTDNVMCSYLPLFNSFNFTKGGLIQLNHGGPQPLQYAVNAAFLASLYSDYLESADTPGWYCGPNFYTTEVLRKFARSQLDYILGKNPLKMSYVVGFGNKYPKRPHHRGASIPHNGVKYGCKGGFKWRESKKANPNVLVGAMVAGPDRHDRFKDIRTNYNYTEPTLAANAGLVAALISIADIPTGRYSIDKNTIFSAIPPMFPTPPPPPSAWKP

SEQ ID NO: 6061 - protein, 621 aa, Setaria italica
MFGRDPWGGPLEISNADSATDDDRSRDLDRAALMRQLDETQQSWLLAGPGDQAGKKKKKYVDLGCVVLDRKIFMWTVGTILGLGVFIGFIMMIVKLVPHKRPPPPPPDQYTQAVHKALMFFNAQRSGPLPKHNGVSWRGNSCMKDGLSDSTTRRSLVGGFYDAGDAIKFNYPMAWSMTMLSWSVIEYKAKYEAIGELDHIKELIKWGTDYILKTFNSSADTIDRIVAQVGIGDTSKGGSQPNDHYCWMRPEDIDYKRPVTECHSCSDLASEMAAALAAASIVFKDSKTYSDKLVKGAKALYKFGRTQRGRYSPNGSDQAIFYNSTSYWDEFVWGGAWMYFATGNNSYLTVATAPGMAKHAGAYWFGSPNYGVFTWDDKLPGAQVLLSRLRLFLSPGYPYEEILRTFHNQTDNVMCSYLPLFNSFNFTKGGLIQLNHGGPQPLQYAVNAAFLASLYSDYLESADTPGWYCGPNFYTTEVLRKFARSQLDYILGKNPQKMSYVVGFGNKYPKRPHHRGASIPHNGVKYGCKGGFKWRESKKANPNILVGAMVAGPDKHDRFKDIRTNYNYTEPTLAANAGLVAALISIADIPTGRYSIDKNTIFSAIPPMFPTPPPPPSAWKP

SEQ ID NO: 6062 - protein, 620 aa, Oryza sativa
MFGRDPWGGPLEISNADSATDDDRSRDLDRGALMRQLDETQQSWLLAGPGDQAGKKKKKYVDLGCMVLDRKIFMWTVGTILGVGLFIGFVMMIVKLVPHKRPPPPPPDQYTQALHKALMFFNAQRSGPLPKHNGVSWRGNSCMKDGLSDSTVRKSLVGGFYDAGDAIKFNYPMAWSMTMLSWSVIEYKAKYEAIGELDHVKELIKWGTDYLLKTFNSSADTIDRIVAQVGVGDTSKGGAQPNDHYCWMRPEDIDYPRPVTECHSCSDLASEMAAALAAASIVFKDSKTYSDKLVRGAKALYKFGRLQRGRYSPNGSDQAIFYNSTSYWDEFVWGGAWMYFATGNNTYLSVATAPGMAKHAGAYWLDSPNYGVFTWDDKLPGAQVLLSRLRLFLSPGYPYEEILRTFHNQTDNVMCSYLPMYNSFNFTKGGMIQLNHGRPQPLQYVVNAAFLASLYSDYLDAADTPGWYCGPTFYTTEVLRKFARSQLDYVLGKNPLKMSYVVGFGNKYPKRAHHRGASIPHNGVKYGCKGGFKWRETKKPNPNILIGALVAGPDRHDGFKDVRTNYNYTEPTLAANAGLVAALISLTNIHVKSGIDKNTIFSAVPPMFPTPPPPPSAWKP

SEQ ID NO: 6063 - protein, 573 aa, Saccharum officinarum
IPGLAHASEKKYVDLGCVVVDRKIFMWTVGTILGLGVFIGFIMMIVKLVPHKRPPPPPPDQYTQALHKALMFFNAQRSGPLPKHNGVSWRGNSCMKDGLSDSTVRRSLVGGYYDAGDAIKFNYPMAWSMTMLSWSVIEYRAKYEAIGELDHIKELIKWGTDYILKTFNSSADTIDRIVAQVGVGDTSKGSSQPNDHYCWMRPEDIDYKRPVTECHSCSDLASEMAAALAAASIVFKDSKTYSDKLVKGAKALYKFGRLQRGRYSPNGSDQAIFYNSTSYWDEFVWGGAWMYFATGNNSYLTVATAPGMAKHAGAYWFGSPNYGVFTWDDKLPGAQVLLSRLRLFLSPGYPYEEILRTFHNQTDNVMCSYLPLFNSFNFTKGGLIQLNHGRPQPLQYAVNAAFLASLYSDYLEAADTPGWYCGPNFYTTEVLRKFARSQLDYILGKNPLKMSYVVGFGNKYPKRPHHRGASIPHNGVKYGCKGGYKWRDTKKANPNILVGAMVAGPDRHDGYKDVRTNYNYTEPTLAANAGLVAALISISDIKTGRFGIDKNTIFSAIPPMFPTPPPPPSAWKP

SEQ ID NO: 6064 - protein, 621 aa, Triticum aestivum
MFGRDPWGGTLEISNADSATDDDRSRDLDRGAMMRHQLDETQQSWLLAGPGDQAGKKKKKYVDIGCMVIDRKIFMWTVGLILGVGLFVGFVMMIVKLVPHKKPPPPPPDQYTLALHKALMFFNAQRSGHLPKHNGVSWRGNSGMKDGLSDSTVKKSLVGGFYDAGDAIKFNYPMAWSMTMLSWTVIEYRAKYEAIGELDHVKEIIKWGTDYMLKTFNSSADTIDRIVAQVGVGDTSKGPMPNDHYCWMRPEDIDYKRPVIECHSCSDLAAEMAAALAAASIVFKDSKAYSDKLVHGAKALYKFGRLQRGRYSPNGSDQSLFYNSTSYWDEFVWGGAWMYFATGNTSYLTIATAPGMAKHAGAFWIGSPNYGVFTWDDKLPGSQVLLSRLRLFLSPGYPYEEILRTFHNQTDNVMCSYLPVFNSFNFTKGGLIQLNHGGPQPLQYVVNAAFLASLYADYLDTADTPGWYCGPNFYTTDVLRKFAKSQLDYILGKNPQKMSYVVGFGKKYPKRVHHRGASIPHNGVKYGCKGGFKWRESKKANPNILVGAMVAGPDKHDGFKDIRTNYNYTEPTLAANAGLVAALISLADIDTGRYSIDKNTIFSAVPPMFPTPPPPPSAWKP

SEQ ID NO: 6065 - protein, 621 aa, Triticum aestivum
MFGRDPWGGTLEISNADSATDDDRSRDLDRGAMMRHQLDETQQSWLLAGPGDQAGKKKKKYVDIGCMVIDRKIFMWTIGLILGVGLFVGFVMMIVKLVPHKKPPPPPPDQYTLALHKALMFFNAQRSGHLPKHNGVSWRGNSGMKDGLSDSTVKKSLVGGFYDAGDAIKFNYPMAWSMTMLSWTVIEYRAKYEAIGELDHVKEIIKWGTDYMLKTFNSSADTIDRIVAQVGVGDTSKGPMPNDHYCWMRPEDIDYKRPVIECHSCSDLAAEMAAALAAASIVFKDSKTYSDKLVHGAKALYKFGRLQRGRYSPNGSDQSLFYNSTSYWDEFVWGGAWMYFATGNTSYLTIATAPGMAKHAGAFWIGSPNYGVFTWDDKLPGSQVLLSRLRLFLSPGYPYEEILRTFHNQTDNVMCSYLPVFNSFNFTKGGLIQLNHGGPQPLQYVVNAAFLASLYADYLDTADTPGWYCGPNFYTTDVLRKFAKSQLDYILGKNPQKMSYVVGFGKKYPKRVHHRGASIPHNGVKYGCKGGFKWRESKKANPNILVGAMVAGPDKHDGFKDIRTNYNYTEPTLAANAGLVAALISLADIDTGRYSIDKNTIFSAVPPMFPTPPPPPSAWKP

SEQ ID NO: 6066 - protein, 621 aa, Hordeum vulgare
MFGRDPWGGTLEISNADSATDDDRSRDLDRGAMMRHQLDETQQSWLLAGPGDQAGKKKKKYVDIGCMVIDRKIFMWTVGLVLGVGLFVGFVMMIVKLVPHKKPPPPPPDQYTLALHKALMFFNAQRSGHLPKHNGVSWRGNSGMKDGLSDSTVKKSLVGGFYDAGDAIKFNYPMAWSMTMLSWTVIEYRAKYEAIGELDHVKEIIKWGTDYMLKTFNSSADTIDRIVAQVGVGDTSKGPMPNDHYCWMRPEDIDYKRPVIECHSCSDLAAEMAAALAAASIVFKDSKAYSDKLVHGAKALYKFGRLQRGRYSPNGSDQSLFYNSTSYWDEFVWGGAWMYFATGNTSYLTIATAPGMAKHAGAFWIGSPNYGVFTWDDKLPGSQVLLSRLRLFLSPGYPYEEILRTFHNQTDNVMCSYLPVFNSFNFTKGGLIQLNHGGPQPLQYVVNAAFLASLYADYLDTADTPGWYCGPNFYTTDVLRKFAKSQLDYILGKNPQKMSYVVGFGKKYPKRVHHRGASIPHNGVKYGCKGGFKWRESKKANPNILVGAMVAGPDKHDGFKDIRTNYNYTEPTLAANAGLVAALISLADIDTGRYSIDKNTIFSAVPPMFPTPPPPPSAWKP

SEQ ID NO: 6067 - protein, 621 aa, Secale cereale
MFGRDPWGGTLEISNADSATDDDRSRDLDRGAMMRHQLDETQQSWLLAGPGDQAGKKKKKYVDIGCMVIDRKIFMWTVGLVLGVGLFVGFVMMIVKLVPHKKPPPPPPDQYTLALHKALMFFNAQRSGHLPKHNGVSWRGNSGMKDGLSDSTVKKSLVGGFYDAGDAIKFNYPMAWSMTMLSWTVIEYRAKYEAIGELDHVKEIIKWGTDYMLKTFNSSADTIDRIVAQVGVGDTSKGPMPNDHYCWMRPEDIDYKRPVIECHSCSDLAAEMAAALAAASIVFKDSKAYSDKLVHGAKALYKFGRLQRGRYSPNGSDQSLFYNSTSYWDEFVWGGAWMYFATGNTSYLTIATAPGMAKHAGAFWIGSPNYGVFTWDDKLPGSQVLLSRLRLFLSPGYPYEEILRTFHNQTDNVMCSYLPVFNSFNFTKGGLIQLNHGGPQPLQYVVNAAFLASLYADYLDTADTPGWYCGPNFYTTDVLRKFAKSQIDYILGKNPQKMSYVVGYGKKFPKRVHHRGASIPHNGVKYGCKGGFKWRESKKANPNILVGAMVAGPDKHDGFKDIRTNYNYTEPTLAANAGLVAALISLADIDTGRYSIDKNTIFSAVPPMFPTPPPPPSAWKP

SEQ ID NO: 6068 - protein, 621 aa, Brachypodium distachyon
MFGRDPWGGTLEISNADSATDDDRSRDLDRGALMRHQLDETQQSWLLAGPGDQAGKKKKKYVDIGCMVIDRKIFLWTVGTILGVGLFIGFVMMIVKLVPHKKPPPPPPDQYTQALHKALMFFNAQRSGPLPKHNGVSWRGNSGMKDGLSDSTARKSLVGGFYDAGDAIKFNFPMAWSMTMLSWTVIEYKAKYEAIGELDHVKEVIKWGTDYILKTFNSSADTIDRIVAQVGVGDTSKGPMPNDHYCWMRPEDIDYKRPVIECHSCSDLAAEMAAALASASIVFKDNKKYSDKLVHGAKALYKFGRLQRGRYSPNGSDQSLFYNSTSYWDEFVWGGAWMYFATGNTSYLTIATAPGMAKHAGAFWLGSPNYGVFTWDDKLPGSQVLLSRLRLFLSPGYPYEEILRTFHNQTDNVMCSYLPQFESFNFTKGGLIQLNHGRPQPLQYVVNAAFLASLYADYLDTADTPGWYCGPHFFKTDVLRKFAKSQIDYILGNNPQKMSYVVGFGKKYPKRVHHRGASIPHNGVKYGCKGGFKWRESKKANPNILVGAMVAGPDRHDGFKDIRTNYNYTEPTLAANAGLIAALISLADIDTGRTAIDKNTIFSAVPPMFPTPPPPPSAWKP

SEQ ID NO: 6069 - protein, 622 aa, Festuca arundinacea
  misc_feature (286)..(286): Xaa can be any naturally occurring amino acid
  misc_feature (546)..(546): Xaa can be any naturally occurring amino acid
MFGRDPWGGTLEISNADSATDDDRSRDLDRGAMMRHQLDETQQSWLLAGPGDQAGKKKKKYVDIGCMVIDRKIFMWTVGTILGVGLFIGFVMMIVKLVPHKKPAPPPPDEYTLALHKALMFFNAQRSGPLPKHNGVSWRGNSGMKDGLSDSTAKKSLVGGFYDAGDAIKFNYPMAWSMTMLSWTVIEYKAKYEKIGELDHVKEIIKWGTDYMLKTFNSSADTIDKIVAQVGIGDTSKGPSPNDHYCWMRPEDIDYKRPVIECHSCSDLAAEMAAALAAASIVFKDXKAYSDKLVHGAKALYKFGRVQRGRYSPNGSDQSLFYNSTSYWDEFVWGGAWMYFATGNTSYLTVATAPGMAKHAGAFWLGSPNYGVFTWDDKLPGSQVLLSRLRLFLSPGYPYEEILRTFHNQTDNVMCSYLPVYNSFNFTKGGLIQLNHGRPQPLQYVVNAAFLASLYADYLDTADTPGWYCGPNFYKTDVLRKFAKSQLDYILGKNPQKMSYVVGYGKKYPKRVHHRGASIPHNGVKYGCKGGFKWRESKKANPNVLXGAMVAGPDRHDGFKDIRTNYNYTEPTLAANAGLVAALISLADIDTGSRTSIDKNTIFSAVPPMFPTPPPPPSAWKP

SEQ ID NO: 6070 - protein, 520 aa, Setaria italica
PPPPPPDQYTQAVHKALMFFNAQRSGPLPKHNGVSWRGNSCMKDGLSDSTTRRSLVGGFYDAGDAIKFNYPMAWSMTMLSWSVIEYKAKYEAIGELDHIKELIKWGTDYILKTFNSSADTIDRIVAQVGIGDTSKGGSQPNDHYCWMRPEDIDYKRPVTECHSCSDLASEMAAALAAASIVFKDSKTYSDKLVKGAKALYKFGRTQRGRYSPNGSDQAIFYNSTSYWDEFVWGGAWMYFATGNNSYLTVATAPGMAKHAGAYWFGSPNYGVFTWDDKLPGAQVLLSRLRLFLSPGYPYEEILRTFHNQTDNVMCSYLPLFNSFNFTKGGLIQLNHGGPQPLQYAVNAAFLASLYSDYLESADTPGWYCGPNFYTTEVLRKFARSQLDYILGKNPQKMSYVVGFGNKYPKRPHHRGASIPHNGVKYGCKGGFKWRESKKANPNILVGAMVAGPDKHDRFKDIRTNYNYTEPTLAANAGLVAALISIADIPTGRYSIDKNTIFSAIPPMFPTPPPPPSAWKP

SEQ ID NO: 6071 - protein, 165 aa, Saccharum officinarum
MSTAPRRPSFRGRGAPPPGTGYVRRGPAPGPADGAKTLRKPVFTTVDQLRPQTHGHTLTARVISARTVLDKPSTHLARTRVAECLVGDSTGTVLVTARNEQVDLLKPDTTVIFRNAKIDMFKGTMRLAVDKWGRIEVTQPADFKVNQDNNMSLVEYELVDVDEEE

SEQ ID NO: 6072 - protein, 166 aa, Zea mays
MSTAPRRPFRGRGAPPPGTGYVRRGPAPAPGPADGAKTLRKPVFTTVDQLRPQTHGHTLTARVISARTVLDKPSTHIGRTRVAECLVGDSTGTVLVTARNEQVDLLKPDTTVIFRNAKIDMFKGTMRLVVDKWGRIEVTQPADFKVNQDNNMSLVEYELVDVDEEE

SEQ ID NO: 6073 - protein, 170 aa, Sorghum bicolor
MSTAPRRGTFRGRGAPPPGTGYVRRGPAPAPAATGPADGAKALRKPVFTTVDQLRPQTHGHTLTARVISARTVLDKPSTHLGRTRVAECLVGDSTGTVLVTARNEQVDLLEPDTTVIFRNAKIDMFKGTMRLAVDKWGRIEVTQPADFKVNQDNNMSLVEYELVDVDEEE

SEQ ID NO: 6074 - protein, 170 aa, Setaria italica
MSTPARRTNRRGPPPPGTGYVRRAPAPAPGPGPGPADAAKPLRKPVFTTIDQLRPQTHGHTLTARVLEARTVLEKHSPHIGRTRVAECLVGDHTGTILVTARNDQVDLVKPNTTVIFRNAKIDMFKGTMRLAVDKWGRIEVTDAADFKVKEDNNMSLVEYELVDVAEEED

SEQ ID NO: 6075 - protein, 212 aa, Unknown
  Sequence found in Organisms: Setaria italica, Panicum virgatum
MDEEEHEVYGQEIPEDGDMDGADVDMAAGGDDAAKLQELDEMKRRLKEMEEEAAALRDMQAKVAKEMQGGDPSASTAEAKEQVDARSVYVGNVDYACTPEEVQQHFQACGTVNRVTILTDKFGQPKGFAYVEFLEQEAVQEALNLNESELHGRQIKVAPKRTNVPGMKQRPPRGYNPYHGYPYRSYGAPYFPPYGYGRAPRFRRPMRYRPYF

SEQ ID NO: 6076 - protein, 212 aa, Saccharum officinarum
MDEEEHEVYGQEIPEDGDMDGADVDMAAAGDDAAKLQELDEMKRRLKEMEEEAAALRDMQAKVAKEMQGGDPSASTAEAKEQVDARSVYVGNVDYACTPEEVQQHFQACGTVNRVTILTDKFGQPKGFAYVEFLEQEAVQEALNLNESELHGRQIKVAPKRTNVPGMKQRPPRGYNPYHGYPYRSYGAPYFPPYGYGRAPRFRRPMRYRPYF

SEQ ID NO: 6077 - protein, 212 aa, Pennisetum glaucum
MDEEEHEVYGQEIPEDGDMDGADVDMAAGGDDAAKLQELDEMKRRLKEMEEEAAALRDMQAKVAKEMQGGDPSASTAEAKEQLDARSVYVGNVDYACTPEEVQQHFQACGTVNRVTILTDKFGQPKGFAYVEFLEQEAVQEALNLNESELHGRQIKVAPKRTNVPGMKQRPPRGFNPYHGYPYRSYGAPYFPPYGYGRAPRFRRPMRYRPYF

SEQ ID NO: 6078 - protein, 212 aa, Sorghum bicolor
MDEEEHEVYGQEIPEDGDMDGADVDMAAAGDDATKLQELDEMKRRLKEMEEEAAALRDMQAKVAKEMQGGDPSASTAEAKEQVDARSVYVGNVDYACTPEEVQQHFQACGTVNRVTILTDKFGQPKGFAYVEFLEQEAVQEAINLNESELHGRQIKVAPKRTNVPGMKQRPPRGYNPYHGYPYRSYGAPYFPPYGYGRAPRFRRPMRYRPYF

SEQ ID NO: 6079 - protein, 212 aa, Panicum virgatum
MDEEEHEVYGQEIPEDGDMDGADVDMAAGGDDAAKLQELDEMKRRLKEMEEEAAALRDMQAKVAKEMQGGDPSASTAEVKEQVDARSVYVGNVDYACTPEEVQQHFQACGTVNRVTILTDKFGQPKGFAYVEFLEQEAVQEALNLNESELHGRQIKVAPKRTNVPGMKQRPPRGFNPYHGYPYRSYGAPYFPPYGYGRAPRFRRPMRYRPYF

SEQ ID NO: 6080 - protein, 212 aa, Zea mays
MDDEEHEVYGQEIPEDGDMDGADVDMAAAGDDAAKLQELDEMKRKLKEMEEEAAALRDMQAKVAKEMQGGDPSISTAEAKEQVDARSVYVGNVDYACTPEEVQQHFQACGTVNRVTILTDKFGQPKGFAYVEFLEQEAVQEALNLNESELHGRQIKVAPKRTNVPGMKQRPPRGYNPYHGYPYRSYGAPYFPPYGYGRAPRFRRPMRYRPYF

SEQ ID NO: 6081 - protein, 212 aa, Oryza sativa
MDEEEHEVYGQEIPEDGDMDGADVDMASGGDDAAKLQELDQMKRRLKEMEEEAAALRDMQAKVAKEMQGGDPSASTAEAKEQVDARSVYVGNVDYACTPEEVQQHFQACGTVNRVTILTDKFGQPKGFAYVEFLEQEAVQEALNLNESELHGRQIKVAPKRTNVPGMKQRPPRGYNPYHGYPYRSYGAPYFPPYGYGRVPRFRRPMRYRPYF

SEQ ID NO: 6082 - protein, 210 aa, Secale cereale
MDEEEHEVYGQEIPVDGDMEGADVDMAATGDDAAKELDEMKRRLKEMEEEAAALRDMQAKVAKEMQGGDANASTAEAKEQVDARSVYVGNVDYACTPEEVQQHFQACGTVNRVTILTDKFGQPKGFAYVEFLEQEAVQEALNLNESELHGRQIKVSPKRTNVPGMKQRPPRGFNPYHAYPYRSYGSPYFPPYGYGRVPRFRRPTRYRPYF

SEQ ID NO: 6083 - protein, 210 aa, Triticum aestivum
MDEEEHEVYGQEIPVDGDMEGADVDMTAAGDDAAKELDEMKRRLKEMEEEAAALRDMQAKVAKEMQGGDANASTAEAKEQVDARSVYVGNVDYACTPEEVQQHFQACGTVNRVTILTDKFGQPKGFAYVEFLEQEAVQEALNLNESELHGRQIKVSPKRTNVPGMKQRPPRGFNPYHAYPYRSYGAPYFPPYGYGRVPRFRRPTRYRPYF

SEQ ID NO: 6084 - protein, 210 aa, Hordeum vulgare
MDEEEHEVYGQEIPVDGDMEGTDVDMAAAGDDAAKELDEMKRRLKEMEEEAAALRDMQAKVAKEMQGGDANASTAEAKEQVDARSVYVGNVDYACTPEEVQQHFQACGTVNRVTILTDKFGQPKGFAYVEFLEQEAVQEALNLNESELHGRQIKVSPKRTNVPGMKQRPPRGFSPYHAYPYRSYGAPYFPPYGYGRVPRFRRPTRYRPYF

SEQ ID NO: 6085 - protein, 210 aa, Pseudoroegneria spicata
MDEEEHEVYGQEIPVDGDMEGADVDMTAAGDDAAKELDEMKRRLKEMEEEAAALRDMQAKVAKEMQGGDANASTAEAKEQVDARSVYVGNVDYACTPEEVQQHFQACGTVNRVTILTDKFGQPKGFAYVEFLEQEAVQEALNLNESELHGRQIKVSPKRTNVPGMKQRPPRGFNPYHAYPCRSYGAPYFPPYGYGRVPRFRRPTRYRPYF

SEQ ID NO: 6086 - protein, 210 aa, Brachypodium distachyon
MDEEEHEVYGQEIPVDGDMEGGDVDMTTGGDDAAKELDEMKRRLKEMEEEAAALRDMQAKVAKEMQGGDANASTAEAKEQVDARSVYVGNVDYACTPEEVQQHFQACGTVNRVTILTDKFGQPKGFAYVEFLEQEAVQEALNLNESELHGRQIKVSPKRTNVPGMKQRPPRGFNPYHGYPYRSYGAQYFPPYGYGRVPRFRRPTRYRPYF

SEQ ID NO: 6087 - protein, 211 aa, Avena sativa
MDEEEHEVYGQEIPVDADMEGADVDMTAGGDDAAKELDEMKRRLKEMEEEAAALRDMQAKVAKEMQGGDANASTAEAKEQVDARSVYVSNVDYACTPEEVQQHFQACGTVNRVTILTDKFGQPKGFAYVEFLEQEAVQEALNLNESELHGRQIKVSPKRTNVPGMKQRPPRGAFNPYHGYPYRSYGSPYFPPYGYGRVPRFRRPTRYRPYF

SEQ ID NO: 6088 - protein, 210 aa, Brachypodium distachyon
MDEEEHEVYGREIPVDGDMEGGDVDMTTGGDDAAKELDEMKRRLKEMEEEAAALRDMQAKVAKEMQGGDANASTAEAKEQVDARSVYVGNVDYACTPEEVQQHFQACGTVNRVTILTDKFGQPKGFAYVEFLEQEAVQEALNLNESELHGRQIKVSPKRTNVPGMKQRPPRGFNPYHGYPYRSYGAQYFPPYGYGRVPRFRRPTRYRPYF

SEQ ID NO: 6089 - protein, 825 aa, Setaria italica
MAPPAFAYAAVAVAVLAAAASAAVTYDRKAVVVNGQRRILLSGSIHYPRSVPEMWPDLIQKAKDGGLDVVQTYVFWNGHEPSPGQYYFEGRYDLVHFIKLVKQAGLYVHLRIGPYVCAEWNFGGFPVWLKYVPGIRFRTDNEPFKSEMQKFTTKIVDMMKSEGLFEWQGGPIILSQIENEFGPLEWDQGEPAKAYASWAANMAVALNTGVPWIMCKEDDAPDPIINTCNGFYCDWFSPNKPHKPTMWTEAWTAWYTGFGIPVPHRPVEDLAYGVAKFIQKGGSFVNYYMYHGGTNFGRTAGGPFIATSYDYDAPIDEYGLLREPKWGHLKELHKAIKLCEPALVAGDPIVTSLGNAQQASVFRSSTGACVAFLENKDKVSYARVAFNGMHYGLPPWSISILPDCKTTVYNTARVGSQISQMKMEWAGGLTWQSYNEDINSLGEESFTTIGLLEQINVTRDKTDYLWYTTYVEIAQDEQFLSNGKNPTLTVMSAGHALHIFINGQLTGTVYGNVEDPRLTYRGSVKLWPGSNTVSCLSIAVGLPNVGEHFETWNAGILGPVTLDGLNEGRRDLTWQKWTYQVGLKGETLSLHSLSGSSSVEWGEPVQKQPLTWYKAFFNAPDGDEPLALDMSSMGKGQIWINGQGIGRYWPGYKASGTCGNCDYRGEYDEKKCQTNCGDSSQRWYHVPRSWLNPTGNLLVIFEEWGGDPTGISMVKRTTGSICADVSEWQPSMKSWHTKDYEKAKVHLQCDHGRKITEIKFASFGTPQGSCGSYSEGTCHAHKSYDIFLKNCIGQERCGVSVVPDVFGGDPCPGTMKRAVVEAICG

SEQ ID NO: 6090 - protein, 827 aa, Oryza sativa
MAASAVAVAFVVAVAAVLAAAASAAVTYDRKAVVVNGQRRILISGSIHYPRSTPEMWPDLIEKAKDGGLDVVQTYVFWNGHEPSPGQYYFEGRYDLVHFIKLVKQAGLYVNLRIGPYVCAEWNFGGFPVWLKYVPGISFRTDNEPFKAEMQKFTTKIVEMMKSEGLFEWQGGPIILSQIENEFGPLEWDQGEPAKAYASWAANMAVALNTSVPWIMCKEDDAPDPIINTCNGFYCDWFSPNKPHKPTMWTEAWTAWYTGFGIPVPHRPVEDLAYGVAKFIQKGGSFVNYYMYHGGTNFGRTAGGPFIATSYDYDAPIDEYGLLREPKWGHLKQLHKAIKLCEPALVAGDPIVTSLGNAQKSSVFRSSTGACAAFLENKDKVSYARVAFNGMHYDLPPWSISILPDCKTTVFNTARVGSQISQMKMEWAGGFAWQSYNEEINSFGEDPLTTVGLLEQINVTRDNTDYLWYTTYVDVAQDEQFLSNGENLKLTVMSAGHALHIFINGQLKGTVYGSVDDPKLTYTGNVKLWAGSNTISCLSIAVGLPNVGEHFETWNAGILGPVTLDGLNEGRRDLTWQKWTYQVGLKGESMSLHSLSGSSTVEWGEPVQKQPLTWYKAFFNAPDGDEPLALDMSSMGKGQIWINGQGIGRYWPGYKASGNCGTCDYRGEYDETKCQTNCGDSSQRWYHVPRSWLSPTGNLLVIFEEWGGDPTGISMVKRSIGSVCADVSEWQPSMKNWHTKDYEKAKVHLQCDNGQKITEIKFASFGTPQGSCGSYTEGGCHAHKSYDIFWKNCVGQERCGVSVVPEIFGGDPCPGTMKRAVVEAICG

SEQ ID NO: 6091 - protein, 785 aa, Sorghum bicolor
MSGSVHYPRSVPEMWPDLIQKAKDGGLDVVQTYVFWNGHEPSRGQYYFEGRYDLVHFIKLVKQAGLYVHLRIGPYVCAEWNFGGFPVWLKYVPGISFRTDNEPFKAEMQKFTTKIVDMMKSEGLFEWQGGPIILSQIENEFGPLEWDQGEPAKAYASWAANMAVALNTSVPWVMCKEDDAPDPIINTCNGFYCDWFSPNKPHKPTMWTEAWTSWYTGFGIPVPHRPVEDLAYGVAKFIQKGGSFVNYYMYHGGTNFGRTAGGPFIATSYDYDAPIDEYGLLREPKWGHLKELHKAIKLCEPALVAGDPIVTSLGNAQQASVFRSSTDACVAFLENKDKVSYARVSFNGMHYNLPPWSISILPDCKTTVYNTARVGSQISQMKMEWAGGFTWQSYNEDINSLGDESFVTVGLLEQINVTRDNTDYLWYTTYVDVAQDEQFLSNGKNPVLTVMSAGHALHIFVNGQLTGTVYGSVDDPKLTYRGNVKLWPGSNTISCLSIAVGLPNVGEHFETWNAGILGPVTLDGLNEGRRDLTWQKWTYKVGLKGEDLSLHSLSGSSSVEWGEPMQKQPLTWYKAFFNAPDGDEPLALDMSSMGKGQIWINGQGIGRYWPGYKASGTCGICDYRGEYDEKKCQTNCGDSSQRWYHVPRSWLNPTGNLLVIFEEWGGDPTGISMVKRTTGSICADVSEWQPSMTNWRTKDYEKAKIHLQCDHGRKMTDIKFASFGTPQGSCGSYSEGGCHAHKSYDIFWKNCIGQERCGVSVVPNVFGGDPCPGTMKRAVVEAICG

SEQ ID NO: 6092 - protein, 871 aa, Sorghum bicolor
RPTCFQFQSSSGGKAPKGAAFFPLALLAPSFHFPPFPLLTSSPLLAPAAPAGLAAVVVVAVLAAAVSAAVTYDRKAVVVNGQRRILMSGSVHYPRSVPEMWPDLIQKAKDGGLDVVQTYVFWNGHEPSRGQYYFEGRYDLVHFIKLVKQAGLYVHLRIGPYVCAEWNFGGFPVWLKYVPGISFRTDNEPFKAEMQKFTTKIVDMMKSEGLFEWQGGPIILSQIENEFGPLEWDQGEPAKAYASWAANMAVALNTSVPWVMCKEDDAPDPIINTCNGFYCDWFSPNKPHKPTMWTEAWTSWYTGFGIPVPHRPVEDLAYGVAKFIQKGGSFVNYYMYHGGTNFGRTAGGPFIATSYDYDAPIDEYGLLREPKWGHLKELHKAIKLCEPALVAGDPIVTSLGNAQQASVFRSSTDACVAFLENKDKVSYARVSFNGMHYNLPPWSISILPDCKTTVYNTARVGSQISQMKMEWAGGFTWQSYNEDINSLGDESFVTVGLLEQINVTRDNTDYLWYTTYVDVAQDEQFLSNGKNPVLTVMSAGHALHIFVNGQLTGTVYGSVDDPKLTYRGNVKLWPGSNTISCLSIAVGLPNVGEHFETWNAGILGPVTLDGLNEGRRDLTWQKWTYKVGLKGEDLSLHSLSGSSSVEWGEPMQKQPLTWYKAFFNAPDGDEPLALDMSSMGKGQIWINGQGIGRYWPGYKASGTCGICDYRGEYDEKKCQTNCGDSSQRWYHVPRSWLNPTGNLLVIFEEWGGDPTGISMVKRTTGSICADVSEWQPSMTNWRTKDYEKAKIHLQCDHGRKMTDIKFASFGTPQGSCGSYSEGGCHAHKSYDIFWKNCIGQERCGVSVVPNVFGGDPCPGTMKRAVVEAICG

SEQ ID NO: 6093 - protein, 831 aa, Setaria italica
PSLSFPPSPLPWRRRLSPTRRSRWPCSPRRRYDRKAVVVNGQRRILLSGSIHYPRSVPEMWPDLIQKAKDGGLDVVQTYVFWNGHEPSPGQYYFEGRYDLVHFIKLVKQAGLYVHLRIGPYVCAEWNFGGFPVWLKYVPGIRFRTDNEPFKSEMQKFTTKIVDMMKSEGLFEWQGGPIILSQIENEFGPLEWDQGEPAKAYASWAANMAVALNTGVPWIMCKEDDAPDPIINTCNGFYCDWFSPNKPHKPTMWTEAWTAWYTGFGIPVPHRPVEDLAYGVAKFIQKGGSFVNYYMYHGGTNFGRTAGGPFIATSYDYDAPIDEYGLLREPKWGHLKELHKAIKLCEPALVAGDPIVTSLGNAQQASVFRSSTGACVAFLENKDKVSYARVAFNGMHYGLPPWSISILPDCKTTVYNTARVGSQISQMKMEWAGALTWQSYNEDINSLGEESFTTIGLLEQINVTRDKTDYLWYTTYVEIAQDEQFLSNGKNPTLTVMSAGHALHIFINGQLTGTVYGNVEDPRLTYRGSVKLWPGSNTVSCLSIAVGLPNVGEHFETWNAGILGPVTLDGLNEGRRDLTWQKWTYQVGLKGETLSLHSLSGSSSVEWGEPVQKQPLTWYKAFFNAPDGDEPLALDMSSMGKGQIWINGQGIGRYWPGYKASGTCGNCDYRGEYDEKKCQTNCGDSSQRWYHVPRSWLNPTGNLLVIFEEWGGDPTGISMVKRTTGSICADVSEWQPSMKSWHTKDYEKAKVHLQCDHGRKITEIKFASFGTPQGSCGSYSEGTCHAHKSYDIFWKNCIGQERCGVSVVPDVFGGDPCPGTMKRAVVEAICG

SEQ ID NO: 6094 - protein, 831 aa, Brachypodium distachyon
MASSAPPAPAVLAVALTVALLASSAWAAVTYDRKAVVVNGQRRILLSGSIHYPRSVPEMWPDLIQKAKDGGLDVVQTYVFWNGHEPSPGQYHFEGRYDLVHFIKLVKQAGLYVHLRIGPYVCAEWNFGGFPIWLKYVPGISFRTDNEPFKAEMQKFTTKIVQMMKSERLFEWQGGPIILSQIENEFGPLEWDQGEPAKDYASWAANMAMALNTGVPWIMCKEDDAPDPIINTCNGFYCDWFSPNKPHKPTMWTEAWTAWYTGFGIPVPHRPVEDLAYGVAKFIQKGGSFVNYYMYHGGTNFERTAGGPFIATSYDYDAPLDEYGLLREPKWGHLKELHRAIKLCEPALVAADPILSSLGNAQKASVFRSSTGACAAFLENKHKLSYARVSFNGMHYDLPPWSISILPDCKTTVFNTARVGSQISQMKMEWAGGLTWQSYNEEINSFSELESFTTVGLLEQINMTRDNTDYLWYTTYVDVAKDEQFLTSGKNPKLTVMSAGHALHVFINGQLSGTVYGSVENPKLTYTGKVKLWSGSNTISCLSIAVGLPNVGEHFETWNAGILGPVTLDGLNEGKRDLTWQKWTYQVGLKGEAMSLHSLSGSSSVEWGEPVQKQPLTWYKAFFNAPDGDEPLALDMNSMGKGQIWINGQGIGRYWPGYKASGTCGHCDYRGEYNETKCQTNCGDPSQRWYHVPRPWLNPTGNLLVIFEEWGGDPTGISMVKRTTGSVCADVSEWQPSIKNWRTKDYEKAEVHLQCDHGRKITEIKFASFGTPQGSCGNYSEGGCHAHRSYDIFKKNCINQEWCGVSVVPEAFGGDPCPGTMKRAVVEVTCS

SEQ ID NO: 6095 - protein, 834 aa, Brachypodium distachyon
MASSAPPAPAVLAVALTVALLASSAWAAVTYDRKAVVVNGQRRILLSGSIHYPRSVPEMWPDLIQKAKDGGLDVVQTYVFWNGHEPSPGQYHFEGRYDLVHFIKLVKQAGLYVHLRIGPYVCAEWNFGGFPIWLKYVPGISFRTDNEPFKARLAEMQKFTTKIVQMMKSERLFEWQGGPIILSQIENEFGPLEWDQGEPAKDYASWAANMAMALNTGVPWIMCKEDDAPDPIINTCNGFYCDWFSPNKPHKPTMWTEAWTAWYTGFGIPVPHRPVEDLAYGVAKFIQKGGSFVNYYMYHGGTNFERTAGGPFIATSYDYDAPLDEYGLLREPKWGHLKELHRAIKLCEPALVAADPILSSLGNAQKASVFRSSTGACAAFLENKHKLSYARVSFNGMHYDLPPWSISILPDCKTTVFNTARVGSQISQMKMEWAGGLTWQSYNEEINSFSELESFTTVGLLEQINMTRDNTDYLWYTTYVDVAKDEQFLTSGKNPKLTVMSAGHALHVFINGQLSGTVYGSVENPKLTYTGKVKLWSGSNTISCLSIAVGLPNVGEHFETWNAGILGPVTLDGLNEGKRDLTWQKWTYQVGLKGEAMSLHSLSGSSSVEWGEPVQKQPLTWYKAFFNAPDGDEPLALDMNSMGKGQIWINGQGIGRYWPGYKASGTCGHCDYRGEYNETKCQTNCGDPSQRWYHVPRPWLNPTGNLLVIFEEWGGDPTGISMVKRTTGSVCADVSEWQPSIKNWRTKDYEKAEVHLQCDHGRKITEIKFASFGTPQGSCGNYSEGGCHAHRSYDIFKKNCINQEWCGVSVVPEAFGGDPCPGTMKRAVVEVTCS

SEQ ID NO: 6096 - protein, 216 aa, Sorghum bicolor
MPIGTPRVPYRTPGEGTWQWLDIWNALYRERIIFIGDNIDEEFSNQVLASMLYLDSIDNSKKIMLYINGPGGDLTPCMALYDTMLSLKSPIGTHCLGFAFNLAGFILAAGEKGSRTGMPLCRISLQSPAGAARGQADDIENEANELIRIKNYLYGKLAEHTGHSVEKIHEDLSRVKRFDAEGALEYGIIDRIIRPSRIKKEGSTAQRRDMRNLGLG

SEQ ID NO: 6097 - protein, 138 aa, Saccharum officinarum
MPIGTPRVPYRTPGEGTWQWLDIWNALYRERIIFIGDNIDEEFSNQVLASMLYLDSIDNSKKIMLYINGPGGDLTPCMALYDTMLSLKSPIGTHCLGFAFNLAGFILAAGEKGSRTGMPLCRISLQAPGGAAQGRLMI

SEQ ID NO: 6098 - protein, 216 aa, Setaria italica
MPIGTPRVPYRTPGEGTWQWLDIWNALYRERIIFIGDNIDEEFSNQVLASMLYLDSIDNTKKILLYINGPGGDLTPCMALYDTMLSLKSPIGTHCLGFAFNLAGFILAAGEKGSRTGMPLCRISLQSPAGAARGQADDIENEANELIRIKNYLYGKLAEHTGHSVEKIHEDLSRVKRFDAEGALEYGIIDRIIRPSRIKKEGSTGHRKDMRNLGLG

SEQ ID NO: 6099 - protein, 216 aa, Panicum virgatum
MPIGTPRVPYRTPGEGTWQWLDIWNALYRERIIFIGDNIDEEFSNQVLASMLYLDSIDNTKKILLYINGPGGDLTPCMALYDTMLSLKSPIGTHCLGFAFNLAGFILAAGEKGSRTGMPLCRISLQSPAGAARGQADDIENEANELIRIKNYLYGKLAEHTGHSVEKIHEDLSRVKRFDAEGALEYGVIDRIVRPSRIKKEGSTAQRKDMRNLGLG

SEQ ID NO: 6100 - protein, 216 aa, Pennisetum glaucum
MPIGTPRVPYRTPGEGTWQWLDIWNALYRERIIFIGDNIDEEFSNQVLASMLYLDSIDNTKRILLYINGPGGDLTPCMALYDTMLSLKSPIGTHCLGFAFNLAGFILAAGEKGSRTGMPLCRISLQSPAGAARGQADDIENEANELIRIKNYLYGKLAEHTGHSVDKIHEDLSRVKRFDAEGALEYGIIDRIIMPSRIKKEGSTGHRKDMRNLGLG

SEQ ID NO: 6101 - protein, 216 aa, Cynodon dactylon
MPIGTPRVPYRTPGEGTWQWLDIWNALYRERIIFIGDNIDEEFSNQVLASMLYLDSVDNTKKILLYINGPGGDLTPCMALYDTMLSLKSPIGTHCLGFAFNLAGFILAAGEKGSRTGMPLCRISLQSPAGAARGQADDIENEANELIRIKNYLYGKLAEHTGHSVEKIHEDLSRVKRFDAEGALEYGIIDRIIRPSRIKKEGSTGERKDRRNLGLG

SEQ ID NO: 6102 - protein, 216 aa, Oryza sativa
MPVGTPRVPYRTPGEGTWQWLDIWNALYRERIIFIGDSIDEEFSNQVLASMLYLDSVDNTKKILLYINGPGGDLTPCMALYDTMLSLKSPIGTHCLGFAFNLAGFILAAGEKGSRTGMPLCRISLQSPAGAARGQADDIENEANELIRIKNYLYSKLSEHTGHPVDKIHEDLSRVKRFDAEGALEYGIIDRIIRPSRIKKEGSTAQKKDLRNLGLG

SEQ ID NO: 6103 - protein, 216 aa, Brachypodium distachyon
MPVGTPRVPYRTPGEGTWQWLDIWNALYRERIIFIGDNIDEEFSNQVLASMLYLDSVDDSKKIILYINGPGGDLTPCMALYDTMLSLKSPIGTHCLGFAFNLAGFILAAGQKGSRTGMPLCRISLQSPAGAARGQADDIENEANELNRIRNYLYGKLSEHTGHPVEKIHEDLDRVKRFDAEGALEYGIIDRIVMPSRIKKEGSTGQKKDLRNLGLG

SEQ ID NO: 6104 - protein, 218 aa, Hordeum vulgare
MPVGTPRVPYRTPGEGTWQWLDIWNALYRERIIFIGDNIDEEFSNQVLASMLYLDSVDDTKKILLYINGPGGDLTPCMALYDTMLSLKSPIGTHCLGFAFNLAGFILAAGQKGSRTGMPLCRVSLQSPAGAARGQADDIENESNELNRIKNYLYGKLAEHTGHSVEKVHEDLSRSKRFDAEGALEYGIIDRIVRPSRIKKEGGSTTGQKKELRNLGLG

SEQ ID NO: 6105 - protein, 218 aa, Unknown
  Sequence found in Organisms: Leymus cinereus x Leymus triticoides, Secale cereale, Triticum aestivum
MPVGTPRVPYRTPGEGTWQWLDIWNALYRERIIFIGDTIDEEFSNQVLASMLYLDSVDDTKKILLYINGPGGDLTPCMALYDTMLSLKSPIGTHCLGFAFNLAGFILAAGQKGSRTGMPLCRVSLQSPAGAARGQADDIENESNELNRIKNYLYGKLAEHTGHSVEKVHEDLSRSKRFDAEGALEYGIIDRIVRPSRIKKEGGSTTGQKKELRNLGLG

SEQ ID NO: 6106 - protein, 218 aa, Avena sativa
MPVGTPRVPYRTPGEGTWQWLDIWNALYRERIIFIGDSIDEEFSNQLLASMLYLDSVDDSKKILLYINGPGGDLTPCMALYDTMLSLKSPIGTHCLGFAFNLAGFILAAGQKGSRTGMPLCRVSLQSPAGAARGQADDIENEANELNRIKNYLYGKLAEHTGHTVEQVHEDLSRVKRFDAEGALDYGIIDRIVRPSRIKKEGGSTTGQKKDLRNLGLG

SEQ ID NO: 6107 - protein, 813 aa, Sorghum bicolor
MEDELGKVKLLKKNPNDEVQRRLAELGDDVSLDRSSEHTNKSTDNSYHQAGISTPSTPMDSGVSNYAEEFDLESVLMNFLGEIYSCHNECPHSDCKNKNELCPSLKALIHKKVNELNNLPRNISCGQSQEGNDVKLPDQNNLSNTMAAQSKQFKDALEILGSNNELFVKLLQKPNPHIADSIQKHENSKVAAGLEPNKIHGQTNFVGGRGGSRQHPLATKEQAKERKYMFFWRKGKSNRRQMLEATDAAQTVSKIVILKPNPERGINQKAATGRTLHQQPCTSHAPECSGRENSKFSIKEVKKRFRFVTGESRREKNLAPAEELQGGPRKLKDSVIAINKDFRHLPEGSLGNKSVSDIKNDIKPFISSKQKQQNGNISEINGHIVTPKGVSIFYEEAKRHLTEMLKDNDCSVNYPAVQISKSLEGILSLPHGNVSTPRSSLRGKDYLDPSPGETDVCIACEVEREECTQERNQSQKDLGSIVLCTSAAVDDQVTVREGYYTNEAQKGPRHADDEPSTLYTEGIDKLICGENVCNERSIPAEQSIDDVCQETLEEIKQGKEHVKVSPTSAEGIVEKLGQQEPETPEPRAATKLISDGSPEQSDEKQERPSPVSVLESFFEDIGSPDCINKKECELHGLQRTLYFPDNEPDANVLWEDKNVRVDYIKLVLELSELCAEQNLEVWYLEDELISPCLFEELQSQGDQTDDLKLLFDCICEALTEIQERYFRLSSWLTFLKHDIRTPPIGENLITEVDRYVYGYIQYSLPSTLEQTMKRDLEVQTWMNIRSKTEGIVMEIWEFVLDELIDETVFDLWM

SEQ ID NO: 6108 - protein, 896 aa, Zea mays
MGRRGHGGSASQDDDGVGCAWGLMRMLYFRRDPKLLLDAKQLSGRHAFREVSERGHSAKRSKDFDEIEEDGNIEECTSQKPTVKNLMEDELGKVKLLKKNPNDEIQRRLVDLGNDVSLGRSSEHTNKSIDRSYHQAGISTPSIPPMDSGVLNYAEEYDLESVLMNFLGEIYSCHDECPHSDCKNKNELCPSLKSLIHKKVNELNNLPRNIGCAQSQEGNDAKLSDQNNLSNTMAARSKQFKDALEILGSNNELFMKLLQKPNQHIVDSIQKHENSKVAAGLEPNKIHGQTNFLVGRGGSRQHPLATKEQAKERKYMFFWRKGKSNRRQMLEATDTDQTVTKIVILKPNPERGFNQKAATARTLHQQPCTSHAPECGGIDNSKFSIKEVKTRFRFVNSESRRESNLAPAEDLQGYPRKFKDSFVAINKDFRHFPEGSLANKSGSDIKNAIKPFISSKQNGSISGNSGHIVAPKGASIFYEEARRHLSEMLKDNDCSVNYPAVQISKSLEGILSLPHGNVSTPRSSLWGKDYLGPSPGETDVFVACEVQREECTQERSQSQEDFGSIARCTSAAVDDQVTVRDGYYTNEAQEGSRHAQNEPGLLYTEGIHKFICGKNICDEQSVPAEQSRHDVCQEILEEIKQGKEHIKMSPTSAEGIVETLGQQEPETPEPRASTELISDGSPEQSDEKQERPSPVSVLESFFEDIDNPDCINKKECELHGLQRTLYFPDNEPDVSLLGEDRSVRVDYIKLVLELSELCAEQNLEVWYLEDELISPCLFEELQSQGDQTDDLKLLFDCICEALTEIQERYFRLSWLTFLKQDIRTPPIGENLITEVDRYVYGYIQHSLPITLEQIIKRDLEVQTWMNIRSKTEGIIMEMWEFVLDELIDETVFDLWI

SEQ ID NO: 6109 - protein, 123 aa, Saccharum officinarum
MEGGETALSGFGGGGAGPPGVDTKVLHAFQTSFVQVQTLLDQNRLLINEINHNHESKVPGDLSRNVGLIRELNNNIRRVVDLYADLSSLFAASDGRAASEGGSVGTVRLAAGAGHKRIRSGLD

SEQ ID NO: 6110 - protein, 121 aa, Cynodon dactylon
MEGGETTLSGFGSGAGAGVDTKVLHAFQTSFVQVQSLLDQNRVLINEINQNHESKVPGDLSRNVGLIRELNNNIRRVVDLYADLSSLFATAEGGRAASEGGSVGTVRQAGAGHKRIRSGLD

SEQ ID NO: 6111 - protein, 124 aa, Setaria italica
MEGGETTLSGFGGGAGAAGAGVDTKVLHAFQTSFVQVQSLLDQNRVLINEINQNHESKVPGDLSRNVGLIRELNNNIRRVVDLYADLSSLFAASDGGRAASEGGSVGTVRQAGAGHKRIRSGLD

SEQ ID NO: 6112 - protein, 127 aa, Sorghum bicolor
MEGGEATLSGFVGGGGGAGGSPGVDTKVLHAFQTSFVQVQTLLDQNRLLINEINQNHESKVPGDLSRNVGLIRELNNNIRRVVDLYADLSSLFAASDAGRAASEGGSVGTVRQAPGAGHKRIRSGLD

SEQ ID NO: 6113 - protein, 118 aa, Zea mays
MEGGDGETTLSGFGVGGVDTKVLHAFQTSFVQVQTLLDQNRLLISEINHNHESKVPGDLSRNVGLIRELNNNIRRVVDLYADLSSLFAASDGASEGGSVGTVRQAGAAGHKRIRSGLD

SEQ ID NO: 6114 - protein, 113 aa, Zea mays
MLLLSSLMRPTLRERSPGTLDSWLWLISLIRRRFWSSSVCTCTKLVWNACSTLVSTPPTPNPDSVVSPSPPSMEPGQLLLVVVGVLVLAILHSLSAAAQSLRWAVRLLRKASH

SEQ ID NO: 6115 - protein, 116 aa, Brachypodium distachyon
MEGDTLSASAHGVDTKVLHAFQTSFVQVQGLLDQNRVLINEINQNHESKVPGDLSRNVGLIRELNNNIRRVVDLYADLSSLFAASSGGGGGRATSEGGSVGTIRQAGHKRIRSGMD

SEQ ID NO: 6116 - protein, 110 aa, Pennisetum glaucum
MEGGETTLSGFGGGGAAGAGVDTKVLHAFQTSFVQVQSLLDQNRVLINEINQNHESKVPGDLSRNVGLIRELNNNIRRVVDLYADLSSLFAASDGGGGRAASEGGSVGTV

SEQ ID NO: 6117 - protein, 768 aa, Setaria italica
MAWHLSILIMATTCFMLFPRSEQSSESELLQQLRKQLEYPRQLDAWGSPSSDPCYTQPTAVLAVTCEGNAITELKIIGDRITKPPKFSGYSVPNVTLSEAFVVDSFVTTLARLTTLRVVILVSLGLWGPLPDKIHRLSSLEVLDLSSNFLYGSIPPKLSVMSKLHTVTLDRNYFNESVPDWLDSFSNLTVLRLQSNRLKGSIPASIGKAAMLTELALAGNSISGDVPNLAYLNKLEMLDLRDNQLDGDLPEMPTALVTILLSKNSLKGEIPKQFGELNRLQHLDLSFNFLVGSPPEGLFALPNISYLNLAANMLSGSLSSSLTCSSTLGFVDLSTNRLTGDLPACLNGNMNNKVVKFDGNCFSVGPAHQHEAKYCQQSHKGSNKDVGLVVTVVGILFIVLVLSLVLMASNRRSCQKVLAEQQFLQKHKQDNSTSGMSSELLVNARCISQAVKLGTQIQPSYRIFSLEELKEATKSFERSAFLGEGAIGKLYKGKLENGTLIAIRCLALHQRYSIRNLKLRLDLLAKLRHPNLVCLLGHCIDSAVDESSVKRVFLVYEYVPGGTLSSYLSGSSPEKTLKWCDRLQLLIAIAKAVHFLHTGIIPGSLYNRLKSSSILLDEHLVSKLSDYGLSIITEEIYKHEVVEEKRYLQNNAAETEDSEDDVYSFGCILLEALMGPKLHEKGGPFVLNDLVASISCQEEREEVLDSVVIGTSSQDSLSIVVSIMIKCLSAQSSTRPSIEEVLWNLQYAAQVQVTTDGDQRSEVSSQAC

SEQ ID NO: 6118 - protein, 112 aa, Setaria italica
MLQKRRIRRMMSTPLVVFYWKHLWDQNPFVLNDLVASISCQEEREEVLDSVVIGTSSQDSLSIVVSIMIKCLSAQSSTRPSIEEVLWNLQYAAQVQVTTDGDQRSEVSSQAC

SEQ ID NO: 6119 - protein, 141 aa, Sorghum bicolor
MQDPRDDDFSAPKLHKKKVVYRPLPSGQLKGEPELLRREFPQSSGMVQKPPKRSLKVEPHTSPSDRGTPDSLTESGPTDEYRALRRKYLMLEEENFALDKELSMEEEEMKALEDEKLALLDQLVVLEGLVEPSQLQSQRRP

SEQ ID NO: 6120 - protein, 61 aa, Saccharum officinarum
MQDPRDDDFSAPKLHKKKVVYRPLPSGQLKGEPELLRREVPQSSGMVHKPPKRDTQKKLEG

SEQ ID NO: 6121 - protein, 142 aa, Panicum virgatum
MQDPNGDDFSAPKLHKKKVVYRPLPSGMLKGEPELLRREVPHSSGMVHKLPKRSLKSERPATPPSDRGTPDSLPDSGPTDEYRALRRKYMMLEEENFALDQELNMEDEEIKALEEEKLALLDELVVLEGLVEPSQLQSHRRP

SEQ ID NO: 6122 - protein, 142 aa, Setaria italica
MQDPSGDDFPAPKLHKKKVVYRPHSSGQLKGEPELLRRDVPHSSGMAQKPPKRSLKSERPATPPSDRGTPDSLPDSGPTDEYRALRRKYMMLEEENFALDNELRMEDEEIKALEEEKLALLDELVVLEGLVEPSQLQFQRRP

SEQ ID NO: 6123 - protein, 142 aa, Setaria italica
MQDPSGDDFSAPKLHKKKVVYRPHSSGQLKGEPELLRRDVPHSSGMAQKPPKRSLKSERPATPPSDRGTPDSLPDSGPTDEYRALRRKYMMLEEENFALDNELRMEDEEIKALEEEKLALLDELVVLEGLVEPSQLQFQRRP

SEQ ID NO: 6124 - protein, 142 aa, Panicum virgatum
MQDPNSDDFSATKLHKKKVVYRLLPSGMLKGEPELLRREGPHSSGMVHKPPKRSLKSECPATPPSDRGTPDSLLDSGPTDEYRALRRKYMMLEEENFALDQELSMEDEEIKALEEEKLAFLDELVVLEGLVEPSQLQSHRRP

SEQ ID NO: 6125 - protein, 142 aa, Pennisetum glaucum
MQNPSGDDFPAPKLHKKKVVYRPHSSGQLRGEPELLRRDVPHSSGMVQKPPKRSLKSERPVTPPSDRGTPDSQPDSGPTDEYRALRRKYMMLEEENFALDNALRMEDEEIKALESEKLALLDELVVLEGLVDPSELQSQRRP

SEQ ID NO: 6126 - protein, 797 aa, Saccharum officinarum
MAFGRGGKMDGRRPSSSSSSSSFCTTTTVVVFVALCLVGAWMMTSSTVFPLEISSNKKPVMKQQPAPVNFGASQETPSGNAGEGSEKFEDTDNNDATVPEEPNNKDAPEEEKFTEKPEEKPEEKEPEVPTEKAETKDMFDDANGKSEGRSDDLKNDDDGEKSGEKKDDEITNESGDEKPDGESKDDQEEKPEGDVTQEEQPQIEEKVEENGEKDQSSNSNEVFPDGAQSELLKESNTQNGSFPTQAAESKNEKKVQASSKSSGDATSYTWKLCNSSASTDYIPCLDNEKAIKKLRTTKHYEHRERHCPEEPPTCLVPLPEGYKRPIEWPKSRDKVWYSNVPHTRLAEYKGHQNWVKVSGDYLLFPGGGTQFKNGALHYIDTIQQALPDIAWGKRSRVILDVGCGVASFGGYMFDRDVLTMSFAPKDEHEAQVQFALERGIPAISAVMGTKRLPYPSRVFDVIHCARCRVPWHIEGGMLLLELNRLLRPGGYFVWSATPVYQKLPEDVEIWNAMSTLTKSMCWKMVNKTKDKLNQVGMVIFQKPMDNVCYEKRSKNNPPLCKESDDADAAWNVPLEACMHKLPVGSKVRGSKWPEFWPQRLEKTPFWIDASKVGVYGKPANEDFEADNAHWKRVVSKSYVNGMGIDWSKVRNVMDMRAVYGGFAAALRDQKVWVMNIVPIDSPDTLPIIYERGLFGMYHDWCESFSTYPRTYDLLHADHLFSKLKKRCKLTAVFAEVDRVLRPQGKLIVRDTADTINELESMAKSLQWEVRMTYTKGNEGLLCVEKSMWRPKELDAST

SEQ ID NO: 6127 - protein, 791 aa, Sorghum bicolor
MAFGRGGKMDGRRPSSTSSSFCTTTTVVVFVALCLVGAWMMTSSTVFPLEISSNKKPVVKQQPAPVNFGASQDNAGEGSEKFEDTDNNDATMPEEPNNKDATMEEKFTEKPEEKPEEKEPEVPTEKAETKDMFDDANGKSEGRSDDMKNDGDGEKSGEKKDDEITNESGDEKPDGESKDDQEEKPEGDATQEEQPQIEEKVEENGEKDQSSNSNEVFPDGAQSELLKESNTQNGSFPTQAAESKNEKEVQASSKSSGDATSYSWKLCNSSASTDYIPCLDNEKAIKKLRTTKHYEHRERHCPEEPPTCLVPLPEGYKRPIEWPRSRDKVWYSNVPHTRLAEYKGHQNWVKVSGDYLLFPGGGTQFKNGALHYIDTIQQALPDIAWGKRSRVILDVGCGVASFGGYMFDRDVLTMSFAPKDEHEAQVQFALERGIPAISAVMGTKRLPYPSRVFDVIHCARCRVPWHIEGGMLLLELNRLLRPGGYFVWSATPVYQKLPEDVEIWNAMSTLTKSMCWKMVNKTKDKLNQVGMVIFQKPMDNICYEKRSENNPPLCKESDDADAAWNVPLEACMHKLPVGSKVRGSKWPEFWPQRLEKTPFWIDGSKVGVYGKPANEDFEADNAHWKRVVSKSYVNGMGIDWSKVRNVMDMRAVYGGFAAALRDQKVWVMNIVPIDSPDTLPIIYERGLFGMYHDWCESLSTYPRTYDLLHADHLFSKLTKRCKLMAVFAEVDRVLRPQGKLIVRDTADTINELESMAKSLQWEVRMTYTKGNEGLLCVEKSMWRPKELDAST

SEQ ID NO: 6128 - protein, 797 aa, Setaria italica
MAFGRGAKMDGRRPSSSSSSFCTTTTVVVFVALCLVGAWMMTSSTVFPLEISSNKKSVVKQQPAPVNFGASEDAASGNAGESSGKFEDTDNNDTTVPEESNNKEAPEEEKFTENMAEKPEEKEQEPPREREENKDMFDDANGKSEGRSDDVKNDNDDGDKSEEKKDDEITNESGDEKPDGERKDDREEKSEGDATQEEQPQIEEKVEESGEKKEQSSNSNEVFPDGAESELLKESNTQNGSFPTQAAESKNEKEVRASSKSSGDESSYSWKLCNSSASTDYIPCLDNEKAIKKLRSTKHYEHRERHCPEEPPTCLVPLPEGYKRPIEWPKSRDKVWYSNVPHTRLAEYKGHQNWVKVSGDYLLFPGGGTQFKNGALHYIDTIQQALPNIAWGKRSRVILDVGCGVASFGGYMFDRDVLTMSFAPKDEHEAQVQFALERGIPAISAVMGTKRLPYPSRVFDVIHCARCRVPWHIEGGMLLLELNRLLRPGGYFVWSATPVYQKLPEDVEIWNAMSALTKSMCWKMVNKTKDKLNQVGMAIYQKPMDNNCYEKRSENNPPLCKDSDDADAAWNVPLEACMHKLPAGPTVRGAKWPESWPQRLEKTPFWLNGSQVGVYGKPANEDFEADNAHWKRVVSKSYVNGMGIDWSKVRNVMDMRAVYGGFAAALRDQKVWVMNIVPIDSPDTLPIIYERGLFGMYHDWCESFSTYPRTYDLLHADHLFSKLKKRCKLMAVFAEVDRVLRPQGKLIVRDTADTINELESMAKSLKWEVRMTYTKGNEGLLCVEKSMWRPKELEAST

SEQ ID NO: 6129 - protein, 796 aa, Pennisetum glaucum
MAFGRGSKMDGRRSSSPSSSFCTTTTVVVFVALCLVGAWMMTSSTVFPLEISSNKKPVVKQQPAAVNFGASEDASSGNVGESSAKFEDTDNNDTTVPEESNNKEAPEEDKFTENTVEKPEEKEQEPPKEREETKNMFDDANGKSEGRSDDVKTDNDDGDKSEEKKDDEITNESGDEKPDGDRKDEQEEKSEVDATQEEQPQIEEKVEENGEKEQSSNSNDVFPDGAQSELLKESNTQNGSFPTQAAESKNEKEVRASSKSSGDETSYSWKLCNSSASTDYIPCLDNEKAIKKLRSTKHYEHRERHCPEEPPTCLVPLPEGYKRPIEWPKSRDKVWYSNVPHTRLAEYKGHQNWVKVSGDYLLFPGGGTQFKNGALHYIDTIQQALPDIAWGKRSRVILDVGCGVASFGGYMFDRDVLTMSFAPKDEHEAQVQFALERGIPAISAVMGTKRLPYPSRVFDVIHCARCRVPWHIEGGMLLLELNRLLRPGGYFVWSATPVYQKLSEDVEIWNAMSALTKSMCWKMVNKTKDKLNQVGMAIYQKPMDNNCYEKRSENNPPLCKDSDDADAAWNVPLEACMHKLPAGPTVRGAKWPESWPQRLEKTPFWLNGSQVGVYGKPANEDFQSDNAHWKRVVSKSYVNGMGIDWSKVRNVMDMRAVYGGFAAALRDQKVWVMNIVPIDSPDTLPIIYERGLFGMYHDWCESFSTYPRTYDLLHADHLFSKLKTRCKLMAVFAEVDRVLRPQGKLIVRDTADTINELEAMAKSLKWEVRMTYTKGNEGLLCVEKSMWRPKELEAST

SEQ ID NO: 6130 - protein, 795 aa, Panicum virgatum
MAFGRGAKMDGRRPSSSSSSFCTTTTVVVFVALCLVGAWMMTSSTVFPLEISSNKKPVVKQQPSPVNFGASEDAASGNTGEGSGKFEDTDNNDTTVPEELSNNEAPEKEKSTENMAEKPEEKEPEQPKEKERTKDMFDDANGKSEGWSDDVKNDGDRDKSEEKKDDEITNESGEEKPDGERKDDQEEKSEGDATQEEQPQIEEKVEENGEKEQSSNSAEVYPDGAQSELLKESNAQNGSFPTQAAESKNEKEVQASSKSLGDETSYSWKLCNSSASMDYIPCLDNVKAIKKLRSTKHYEHRERHCPEEPPTCLVPLPEGYKRPIEWPKSRDKVWYSNVPHTKLAEYKGHQNWVKVSGDYLLFPGGGTQFKNGALHYIDTIQQALPDIAWGKRSRVILDVGCGVASFGGYMFDRDVLTMSFAPKDEHEAQVQFALERGIPAISAVMGTKRLPYPSRVFDVIHCARCRVPWHIEGGMLLLELNRLLRPGGYFVWSATPVYQKLPEDIEIWNAMSILTKSMCWKMVNKTKDKLNQVGMAIYQKPMDNNCYEKRSENNLPLCKESDAADAAWNVPLEACMHKLPVGPTLRGAKWPESWPQRLNKTPFWVDGSQVGVYGKPANEDFEADNAHWKRVVSKSYLNGMGIDWSKVRNVMDMRAVYGGFAAALKNQKVWVMNIVPIDSPDTLPIIYERGLFGMYHDWCESFSTYPRTYDLLHADHLFSKLKTRCKLLAVFAEVDRVLRPEGKLIVRDTADTINELESMAKSLKWEVRMTYTKGNEGLLCVEKSMWRPKEVEASM

SEQ ID NO: 6131 - protein, 808 aa, Hordeum vulgare
MAFGRGGKMDGRRPSSPSSSLCTTTTVVVFVALCVVGAWMMTSSTVFPVEPTSNKRSEPLEVSTSNKKTEVKDQRAEVGFGETEETATSGNAGSEKFEDTDNNDNVPDESHSNRDAPEEEKFTENTMEKPVEMSEEKEPPKEKEDSKDSFDDANGKSEGHSAKEGGESGDEEEKSEERKDKETNTDNDVEKSDGEKKEDQEGKSEDDATEQPQIEEKVEESGEKEPAAKANEVFPDGAQSELLKESNTENGSFPTQAAESKNEKEAQAASKSSGDEITYSWKLCNSSAVTDYIPCLDNEKAIKKLHSTKHYEHRERHCPEEPPTCLVPLPEGYKRPIEWPKSRDKVWYSNVPHTKLAEYKGHQNWVKVSGDHLLFPGGGTQFKNGALHYIDTIQQALPDIAWGKRSRVILDVGCGVASFGGYMFDRDVLTMSFAPKDEHEAQVQFALERGIPAISAVMGTKRLPYPSRVFDVIHCARCRVPWHIEGGKLLLELNRLLRPGGYFVWSATPVYQKLPEDVEIWNAMSSLTKSMCWKMVKKTKDTLNQVGMAIYQKPMDNNCYEKRSEDSPPLCKETDDADAAWNVPLQACIPKLPPGPSVRGSKWPEMWPQRLEKTPFWIDGSRVGVYGKPANEDFEADYAHWKRVVSKSYVNGMGIDWSKVRNVMDMRAVYGGFAAALRDQKVWVMNIVPIDSPDTLPIVYERGLFGMYHDWCESFSTYPRTYDLLHADHLFSKLKKRCKLLGVFAEVDRILRPEGKLIVRDDAETIRALEGMAKSLQWEVRMTYATGKEGLLCVQKTTWRPKEIEASM

SEQ ID NO: 6132 - protein, 808 aa, Triticum aestivum
MAFGRGAKMDGRRPSSPSSSMCTTTTVVVFVALCMVGAWMMTSSTVFPVEPTSNKKSEPIEVSTSNKKTEVKDQRAEVGFGETDEAAKSGSVSSERFEDTDNNDNVPDESHSNRDAPEEEKFPENAMEKPVEMAEEKEPPKEKEDSKDSFDDANGKSEGQSAKEGGESGDEEEKSEERKDKETTTDNDVEKSDAEKKEDQEGKSEDDATEQPQIEEKVEESGEKEPAAKANEVFPDGAQSELLKESNTENGSFPTQAAESKNEKEAQAASKSSGDEITYSWKLCNSSAVTDYIPCLDNEKAIKKLHSTKHYEHRERHCPAEPPTCLVPLPEGYKRPIEWPKSRDKVWYSNVPHTKLAEYKGHQNWVKVSGDHLLFPGGGTQFKNGALHYIDTIQQALPDIAWGKRSRVILDVGCGVASFGGYMFDRDVLTMSFAPKDEHEAQVQFALERGIPAISAVMGTKRLPYPSRVFDVIHCARCRVPWHIEGGKLLLELNRLLRPGGYFVWSATPVYQKLPEDVEIWNAMSSLTKSMCWKMVKKTKDTLNQVGMAIYQKPMDNNCYEKRSEDSPPLCKETDDADAAWNVPLQACIPKLPIGPSVRGSKWPEMWPQRLEKTPFWIDGSRVGVYGKPANEDFEADYAHWKRVVSKSYVNGMGIDWSKVRNVMDMRAVYGGFAAALRDQKVWVMNIVPIDSPDTLPIVYERGLFGMYHDWCESFSTYPRTYDLLHADHLFSKLKKRCKLLGVFAEVDRILRPEGKLIVRDDAETISELESMAKSLQWEVRMTYARGKEGLLCVQKTTWRPKEIEASM

SEQ ID NO: 6133 - protein, 808 aa, Secale cereale
MAFGRGAKMDGRRPSSPSSSLCTTTTVVVFVALCLVGAWMMTSSTVFPVEPTSTKKSESLEVSTSNKKTEVKDQRAEVGFGETDDAAKSGSVSSEKFEDTDNNDNVPDESHSNRDAPEEEKFPENTMEKPVEMAEEKEPPKEKEDSKDSFDDANGKSETQNAKEGGESGDEEEKREEKKDEETTTDNDVEKSDGEKKEDQEGKSEDDATEQPQIEEKVEESGEKEPAAKANEVFPDGAQSELLKESNTENGSFPTQAAESKNEKEAQAASKSSGDEITYSWKLCNTSAVTDYIPCLDNEKAIKKLHSTKHYEHRERHCPEELPTCLVPLPEGYKRPIEWPKSRDKVWYSNVPHTKLAEYKGHQNWVKVSGDHLLFPGGGTQFKNGALHYIDTIQQALPDIAWGKRSRVILDVGCGVASFGGYMFDRDVLTMSFAPKDEHEAQVQFALERGIPAISAVMGTKRLPYPSRVFDVIHCARCRVPWHIEGGKLLLELNRLLRPGGYFVWSATPVYQKLPEDVEIWNAMSSLTKSMCWKMVKKTKDTLNQVGMAIYQKPMDNNCYEKRPEDSPPLCKESDDADAAWNVPLQACIPKLPIGPSVRGSKWPETWPQRLEKTPFWIDGSRVGVYGKPANEDFEADYAHWKRVVSKSYVNGMGIDWSKVRNVMDMRAVYGGFAAALRDQKVWVMNIVPIDSPDTLPIVYERGLFGMYHDWCESFSTYPRTYDLLHADHLFSKLKKRCKLLGVFAEVDRILRPEGKLIVRDNAETISELEGMAKSLHWEVRMTYAKGKEGLLCVQKTTWRPKEIEASM

SEQ ID NO: 6134 - protein, 808 aa, Secale cereale
MAFGRGAKMDGRRPSSPSSSLCTTTTVVVFVALCLVGAWMMTSSTVFPVEPTSTKKSESLEVSTSNKKTEVKDQRAEVGFGETDDAAKSGSVSSEKFEDTDNNDNVPDESHSNRDAPEEEKFPENTMEKPVEMAEEKEPPKEKEDSKDSFDDANGKSETQNAKEGGESGDEEEKREEKKDEETTTDNDVEKSDGEKKEDQEGKSEDDATEQPQIEEKVEESGEKEPAAKANEVFPDGAQSELLKESNTENGSFPTQAAESKNEKEAQAASKSSGDEITYSWKLCNTSAVTDYIPCLDNEKAIKKLHSTKHYEHRERHCPEELPTCLVPLPEGYKRPIEWPKSRDKVWYSNVPHTKLAEYKGHQNWVKVSGDHLLFPGGGTQFKNGALHYIDTIQQALPDIAWGKRSRVILDVGCGVASFGGYMFDRDVLTMSFAPKDEHEAQVQFALERGIPAISAVMGTKRLPYPSRVFDVIHCARCRVPWHIEGGKLLLELNRLLRPGGYFVWSATPVYQKLPEDVEIWNAMSSLTKSMCWKMVKKTKDTLNQVGMAIYQKPMDNNCYEKRPEDSPPLCKESDDADAAWNVPLQACIPKLPIGPSVRGSKWPETWPQRLEKTPFWIDGSRVGVYGKPANEDFEADYAHWKRVVSKSYVNGMGIDWSKVRNVMDMRAVYGGFAAALRDQKVWVMNIVPIDSPDTLPIVYERGLFGMYHDWCESFSTYPRTYDLLHADHLFSKLKKRCKLLGVFAEVDRILRPEGKLMVRDNAETISELEGMAKSLHWEVRMTYAKGKEGLLCVQKTTWRPKEIEASM

SEQ ID NO: 6135 - protein, 803 aa, Triticum aestivum
MAFGRGAKMDGRRPSSPSSSMCTTTTVVVFVALCLVGAWMMTSTTVFPVEPTSNKKSEPIEVSTSNKKTEVKDQRAEVGFGETDEAAKSGSVSSEKFEDTDNNDNVPDESHSNRDAPEEEKFPENTMEKPVEMAEEKEPPKEKEDSKDSFDDANGKSEGQSAKEGGETGQSGDEEEKSTTDNDVEKSDGEKKEDQEGKSEDDATEQPQIEEKVEESGEKEPAAKANEVFPDGAQSELLKESNTENGSFPTQAAESKNEKEAQAASKSSGDEITYSWKLCNSSAVTDYIPCLDNEKAIKKLHSTKHYEHRERHCPAEPPTCLVPLPEGYKHPIEWPKSRDKVWYSNVPHTKLAEYKGHQNWVKVSGDHLLFPGGGTQFKNGALHYIDTIQQALPDIAWGKRSRVILDVGCGVASFGGYMFDRDVLTMSFAPKDEHEAQVQFALERGIPAISAVMGTKRLPYPSRVFDVIHCARCRVPWHIEGGKLLLELNRLLRPGGYFVWSATPVYQKLPEDVEIWNAMSSLTKSMCWKMVKKTKDTLNQVGMAIYQKPMDNNCYEKRSEDSPPLCKETDDADAAWNVPLQACIPKLPIGPSVRGSKWPEMWPQRLEKTPFWIDGSRVGVYGKPANEDFEADYAHWKRVVSKSYVNGMGIDWSKVRNVMDMRAVYGGFAAALRDQKVWVMNIVPIDSPDTLPIVYERGLFGMYHDWCESFSTYPRTYDLLHADHLFSKLKKRCKLLGVFAEVDRILRPEGKLIVRDNAETISELEGMAKSLQWEVRMTYAKDKEGLLCVQKTTWRPKEIEASM

SEQ ID NO: 6136 - protein, 242 aa, Secale cereale
MAFGRGAKMDGRRPSSPSSSLCTTTTVVVFVALCLVGAWMMTSSTVFPVEPTSTKKAEPLEVSTSNKKTEVKDQRAEVGFGETDDAAKSGSVSSEKFEDTDNNDNVPDESHSNRDAPEEEKFPENTMDKPVEMAEEKEPPKEKEDSKDSFDDANGKSETQNAKEGGESGDEEEKREEKKDEETTTDNDVEKSDGEKKEDQEGKSEDDATEQPQIEEKVEESGEKEPAAKANEVFLMELSLNF

SEQ ID NO: 6137 - protein, 388 aa, Sorghum bicolor
MLPSHLNGHSALGRGRPRLSAAAASGDFAAAGIGAAAPLEEHDRIYFQSYSHLGIHEAMIKDRVRTDAYHTAIMRHQKFVEGKVVLDVGCGTGILSVFCARAGAKRVYAIEASEIAVQAREIVKANNLTDQVVVIHGRVEDVDLEEKVDVIISEWMGYMLLYESMLPSVLFARDKWLKPGGLILPSHATLFMAPITNPERYESSVDFWRDVYGINMSALVPLAKKFTSEEPSIETIGGENVISWPAVFKHIDCYNFTAEEFKSITTKYKVSSMMLAPIHGFGFWFEVEFNGPAESSHNFPSNLDPLEIIQKKRRRSSEDAVLSTAPEDEPTHWQQTILYFPDPIEVKQDQIIEGSVTVSQSEENPRFLNIHLECTTGGQTLVKDCAMR

SEQ ID NO: 6138 - protein, 395 aa, Setaria italica
MLPSHLNGHSPLARRRPRLCAASPPAAAGESPAAGAGATSAALSLEEHDRIYFQSYSHIGIHEAMIKDRVRTDAYHTAIMHHQKFIEGKVVLDVGCGTGILSVFCARAGAKRVYAVEASEIATQAREIVKANNLTDQVVVIHGRVEDVDLEEKVDVIISEWMGYMLLYESMLPSVLFARDKWLKPGGLILPSHATLFMAPITNPERYEGSVDFWCDVYGINMSALVPLAKKFTSEEPSIETIGGENVISWPSVVKHIDCYNFTAEEFKSITANYKVSSMMLAPIHGFGFWFEVEFNGPQESSHNIPSNLNPLEIIHKKRRRSSEDTVLLSTAPEDEPTHWQQTILYFPDPIEVKQDQTVEGSVTVSQSKENPRFLNIHLECSTGGQTLVKDCTMR

SEQ ID NO: 6139 - protein, 396 aa, Panicum virgatum
MLPSHLNGHSPLARRRPRLSAASPPAAAAGESPAAGAGATSTADSLEEHDRIYFQSYSHIGIHEAMIKDRVRTDTYHSAIMHHQKFIEGKVVLDVGCGTGILSVFCARAGAKRVYAVEASEIAIQACEIVKANNLSDKVVVIHGRVEDVDLEEKVDVIISEWMGYMLLYESMLPSVLFARDKWLKPGGLILPSHATLFMAPITNPERYEGSVDFWCDVYGIDMSALVPLAKKITSEEPSIETIGGENVISWPSVVKHIDCYNFTVEEFKCITAKYKVSSMMLAPIHGFGFWFEVEFNGPQESSHNIPSNLNPLEIIQKKRRRSSEDTVLLSTAPEDEPTHWQQTILYLPDPIEVKQDQTVEGSVTVSQSKENPRFLNIHLECSTGGHTLVKDCAMR

SEQ ID NO: 6140 - protein, 388 aa, Brachypodium distachyon
MLPSHLNGHSPLARRPRLSAAAGDPPAAAAEAAGAASLEAHDRVYFQSYSHIGIHEAMIKDRVRTDAYRTAIMHHQKFIEGKVVMDVGCGTGILSVFCARAGAKRVYAVDASEIATQATEIVKANNLADKIVVIHGRVEDVDIKEKVDVIISEWMGYMLLYESMLPSVLFARDKWLKPGGLILPSHATLFMAPITNSDRYEGSVDFWCDVYGINMSALVPLAKKFTSEEPSIEIISGENVISWPFVVKHIDCYTFTVEEFKSVTTTYKVSSMMLAPIHGFGLWFEVEFNGPAESLDDLSANSNPLDIIQKKRRRGSDNTVLLSTAPEDEPTHWHQTILYFPDPIEVKQDQIIEGSVMVTPSEENPRCLNIRLECSTGGQTLVKDFAMR

SEQ ID NO: 6141 - protein, 391 aa, Oryza sativa
MLPSHLNGHSPLARRCPRLSAASPPATGDSDAAAAAADAPLAEHDRIYFQSYSHIGIHEAMIKDRVRTDAYRSAIMHHQKFIEGKVVMDVGCGTGILSVFCARAGAKCVYAVEASEMATQAREIVKANNLDDKVVVVHGRVEDVEVEDKVDVIISEWMGYMLLYESMLPSVLFARDKWLKPGGLILPSHATLFMAPITNSERYEGSVDFWSDVYGINMSALVPLAKKFTSEEPSIEIIGGENVLSWPFVVKHIDCYTFKAEELKSFTTKYKVSSMMLAPIHGFGLWFEVEFNGPSNPTDKSPSDLNPLDVIRKKRRRGSEDPVVLSTAPEDEPTHWHQTILYFPDPIEVKQDQIIEGSVKVSQSEENPRFLNIQLDCTTGGQTLVKDYAMR

SEQ ID NO: 6142 - protein, 388 aa, Secale cereale
MLPSHLNGHSPLARRRPQLPAASPPASAGEPPAAAAALEAHDRVYFQSYSHIGIHESMIKDRVRTDAYREAIMLHQKFIEGKVVMDVGCGTGILSVFCARAGAKRVYAVDASEIATQASEIVKANNLADKIVVIHGRVEDVDVEEKVDVIISEWMGYMLLYESMLPSVLFARDKWLKPGGLILPSHATLFMAPITNSDRYEGSVDFWCDVYGINMSALVPLAKKFASEEPSIEIVGGENVISWPFVVKHIDCYTFTVEEFKSITTTYKVSSMMLAPIHGFGLWFEVEFNGPAESCSNLSSDSSPLDIIQKKRRRASDNTVVLSTAPEDEPTHWHQTILYFPDPIGVTQDQIIEGSVTITPSEENPRCLNIHLECSTGGQNLVKDFAMR

SEQ ID NO: 6143 - protein, 270 aa, Sorghum bicolor
MAMAAVGVGGAVASLLPQRRRGGTVVTWSGAAACVGRRRRASVAVRASYEAGVGVMATKVGMMTYFDPETGKPVPVTVVGFREGGNVVTQVKTAATDGYDAVQVGYHGVREDKLTRPELGHLGKAGAPPLKHLQEFRLTAVDAFEPGQPLDFADLFKEGDIIDVSGNTIGKGFQGGIKRHNFKRGLMTHGSKSHRQLGSIGAGTTPGRVYKGKKMPGRMGGKKTKIRKLKIVKIDNDLRVLMIKGAVPGKPGNLLRITPAKIVGKNIPKN

SEQ ID NO: 6144 - protein, 266 aa, Setaria italica
MAMAAVGIAGGALALLLPQQRGRRGGGCAVSFRRAGASVTVRASYEAGVGVMATKVGMMTYFDPETGKPVPVTVVGFRDGGNVVTQVKTAATDGYDAVQVGYHGVRDDKLTRPELGHLGKAGAPPLRHLQEFRLTTVDAFEPGQELDFAELFKEGDLVDVSGNSIGKGFQGGIKRHNFKRGLMTHGSKSHRQLGSIGAGTTPGRVYKGKKMPGRMGGTKTKIRKLKIVKIDNDLRVVMIKGAVPGKPGNLLRIAPAKIVGKNIPKN

SEQ ID NO: 6145 - protein, 215 aa, Pennisetum glaucum
MATKVGMMTYFDPETGKPVPVTVVGFRDGGNVVTQVKTAATDGYDAVQVGYHGVREDKLTRPELGHLGKAGAPPLKHLQEFRLTAVDAFEPGQELDFAELFKEGDLVDVSGNSIGKGFQGGIKRHNFKRGLMTHGSKSHRQLGSIGAGTTPGRVYPGKKMPGRMGGTKTKIRKLKIVKIDNDLRVVMIKGAVPGKPGNLLRIAPAKIVGKNIPKN

SEQ ID NO: 6146 - protein, 215 aa, Brachypodium distachyon
MATKVGMMTYFDPANGKPVPVTVVGFRDGGNVVTQVKTAATDGYDAVQVGYHGVREDKLTRPELGHLGKAGAPPLRHLQEFRLQAVDAFGPGQALEFAELFKEGDLVDVSAKTIGKGFQGGIKRHNFKRGLMTHGSKSHRALGSIGAGTTPGRVYKGKKMPGRMGGTKTKIRKLKIVRIDNDLKVVMIKGAIPGKQGNLLRITPAKIVGKNIPKS

SEQ ID NO: 6147 - protein, 258 aa, Brachypodium distachyon
MAAMAAASVGGALGFLAPRRRIAVGAAPRRVAVRASYEAGVGVMATKVGMMTYFDPANGKPVPVTVVGFRDGGNVVTQVKTAATDGYDAVQVGYHGVREDKLTRPELGHLGKAGAPPLRHLQEFRLQAVDAFGPGQALEFAELFKEGDLVDVSAKTIGKGFQGGIKRHNFKRGLMTHGSKSHRALGSIGAGTTPGRVYKGKKMPGRMGGTKTKIRKLKIVRIDNDLKVVMIKGAIPGKQGNLLRITPAKIVGKNIPKS

SEQ ID NO: 6148 - protein, 84 aa, Panicum virgatum
MTHGSKSHRQLGSIGAGTTPGRVYKGKKMPGRMGGTKTKIRKLKIVKIDNDLRVLMIKGAVPGKPGNLLRIAPAKIVGKNIPKN

SEQ ID NO: 6149 - protein, 264 aa, Hordeum vulgare
MAMAAASIGGALGFLAPRRRGVSFAAAVGRRRPSLAVVRAASYEAGVGVMATKVGMMTYFDPANGKPVPVTVVGFREGGNVVTQVKTAATDGYDAVQVGYHGVREDKLTRPELGHLGKASAPPLRHLQEFRLVAVDAFDPGQELEFNELFKEGDLVDVSAKSIGKGFQGGIKRHNFKRGLMTHGSKSHRALGSIGAGTTPGRVYKGKKMPGRMGGTKTKIRKLKIVRIDNDLKVVMIKGAIPGKQGNLLRITPAKIVGKNIPKS

SEQ ID NO: 6150 - protein, 237 aa, Setaria italica
VSFRRAGASVTVRASYEAGVGVMATKVGMMTYFDPETGKPVPVTVVGFRDGGNVVTQVKTAATDGYDAVQVGYHGVRDDKLTRPELGHLGKAGAPPLRHLQEFRLTTVDAFEPGQELDFAELFKEGDLVDVSGNSIGKGFQGGIKRHNFKRGLMTHGSKSHRQLGSIGAGTTPGRVYKGKKMPGRMGGTKTKIRKLKIVKIDNDLRVVMIKGAVPGKPGNLLRIAPAKIVGKNIPKN

SEQ ID NO: 6151 - protein, 265 aa, Avena sativa
MAMAAASIGGALGFLAPRRRGVSFSGAGGARRRPPLAVVRAASYEAGVGVMATKVGMMTYFDPSNGKPVPVTVVGFRDGGNVVTQIKTAATDGYDSVQVGYHGVREDKLTRPELGHLGKAGAPPLRHLQEFRLVAVDAFDPGQELEFNELFKEGDLVDVSAKTIGKGFQGGIKRHNFKRGLMTHGSKSHRALGSIGAGTTPGRVYKGKKMPGRMGGTKTKIRKLKIVRIDNDLKVVMIKGAIPGKQGNLLRITPAKIVGKNIPKS

SEQ ID NO: 6152 - protein, 215 aa, Oryza sativa
MATKVGMMTYFDPATGKPVPVTVVGFREGGNVVTQVKTAATDGYDAVQVGYHGVREEKLTRPELGHLGKAGAPPLRHLQEFRLQSVDGYDPGQPLDFADMFKEGDLVDISGKSIGKGFQGGIKRHNFKRGLMTHGSKSHRALGSIGAGTTPGRVYKGKKMPGRMGGTKTKIRKLKIVKIDNDLKVVMIKGAVPGKPGNLLRIAPAKIVGKNIPKN

SEQ ID NO: 6153 - protein, 259 aa, Secale cereale
ASIGGALGFLAPRRRGVSFAAAVGRRRPSLAVVRAASYEAGVGVMATKVGMMTYFDPENGKPVPVTVVGFREGGNVVTQVKTAATDGYDAVQVGYHGVREDKLTRPELGHLGKASAPPLRHLQEFRLVAVDAFDPGQALEFNELFKEGDLVDVSAKTIGKGFQGGIKRHNFKRGLMTHGSKSHRALGSIGAGTTPGRVYKGKKMPGRMGGTKTKIRKLKIVRIDNDLKVVMIKGAIPGKQGNLLRITPAKIVGKNIPKS

SEQ ID NO: 6154 - protein, 215 aa, Leymus cinereus x Leymus triticoides
MATKVGMMTYFDPANGKPVPVTVVGFRDGGNVVTQVKTAATDGYDAVQVGYHGVREDKLTRPELGHLGKASAPPLRHLQEFRLVAVDAFDPGQALEFNELFKEGDLVDVSAKSIGKGFQGGIKRHNFKRGLMTHGSKSHRALGSIGAGTTPGRVYKGKKMPGRMGGTKTKIRKLKIVRIDNDLKVVMIKGAIPGKQGNLLRITPAKIVGKNIPKS

SEQ ID NO: 6155 - protein, 283 aa, Sorghum bicolor
MSEHRAPRSSVGSRSSALPHHHQRLPPAPDPLASIWIRRLHLSPNPPPPPPPPPRPPPLHIRAPPSAHQDAISTDESRTPPPLPPPSTGFGPFRWSPRPSLGAPAGAWAAAAGRSAVGGGQTMLSPFFRLPAPLPPVLDFEEVMPLRPLIGLRSHSGSGGFPGLSRQMVGGGDPGDAWLSARAAGAAYPSHALDMVPIRTLNDLHDRQHGAIQVQPNLARHDPSSSSQDDEPFSYWNMGRFRRNTTTSSMTPIGVAPVNFGTKRNADSNNFLPLKLRKLSGAI

SEQ ID NO: 6156 - protein, 96 aa, Zea mays
MASSDGQTEAAAPSVPKNPAMASCRKKKTDDATFLEDLKDHIDEFIHASMDEHKTCFKKTIQKMFGMSKAVAERSAAEAKEAGVESALPLQTSVSQ

SEQ ID NO: 6157 - protein, 96 aa, Sorghum bicolor
MASSTSQTEAPAPSVPKNPAMASCRKKKTDDATFLEDLKDHIDEFIHASMDEHKTCFTKTIQKMFGMSKAVAERSAAEAKEAEVESALPLQTSVSQ

SEQ ID NO: 6158 - protein, 96 aa, Panicum virgatum
MDSSNVQSEGSAPSVPKNPAMASCRKKKTDDATFLEDLKDHIDEFVHASMDEHKTCFKKTIQKMFGMSKAVAERSAAGAKEAEVESALPLQTSVSQ

SEQ ID NO: 6159 - protein, 97 aa, Setaria italica
MDPSNAQSEASAPSVPKNPAMASCRKKKTDDDVTFLEDLKDHIDEFIHASMDEHKTCFKKTIQKMFGMSKVVAERSAAGAKEAEVESALPLQTSVSQ

SEQ ID NO: 6160 - protein, 96 aa, Panicum virgatum
MDSSNAQSEGSAPSVPKNSAMASCRKKKTDDATFIEDLKDHIDEFIHASMDEHKTCFKKTIQKMFGMSKVVAERSAAGAKEAEVESALPLQTSVSQ

SEQ ID NO: 6161 - protein, 94 aa, Pennisetum glaucum
MDSSNAQSAPSVPKNPAMASCRKKKTDDDVTFLEDLKDHIDEFIHASMDEHKTCFKKTIQKMFGMSKVVAERSAAGAKEAEVESALPLQTSVSQ

SEQ ID NO: 6162 - protein, 96 aa, Unknown
  Sequence found in Organisms: Secale cereale, Triticum aestivum
MDSGNTQTEGSQPPVPKNPAMTSCRKKKTDDDVTFLEDVKEHIDEFIHASMDEHKTCFKKTIQKMFGMSKVVAERSAAAKEAEVESALPLQTSVSQ

SEQ ID NO: 6163 - protein, 96 aa, Hordeum vulgare
MDSGNTQTEGSQPPVPKNPAMTSCRKKKTDDDVTFLEDVKEHIDEFINASMDEHKTCFKKTIQKMFGMSKAVAERSAAAKEAEVESALPLQTSVSQ

SEQ ID NO: 6164 - protein, 95 aa, Avena sativa
MDSSNAQSEGSQPSVPKTPAMASCRKKKTDDASFLEDVKEHLDEFINASMDEHKTCFKKTISKMFGMSKMVAERSAAAKEAEVESALPLQTSVSQ

SEQ ID NO: 6165 - protein, 95 aa, Oryza sativa
MESIKTQSQGSASSVPKNPAMSSCRKKKSDDATFLEDLKDHIDEFIHASMDEHKHCFKNTIQKMFGMSKVVAERSAEAKEAEVESALPLQTSVSQ

SEQ ID NO: 6166 - protein, 94 aa, Oryza sativa
MESSKTQSQGSASVPKNPAMSSCRKKKSDDVTFLEDLKDHIDEFIHASMDEHKHCFKNTIQKMFGMSKVVAERSAEAKEAEVESALPLQTSVSQ

SEQ ID NO: 6167 - protein, 97 aa, Triticum aestivum
MDSSNAQSEGSQPPVPPKNPTMSSCRKKKTDDDATFLEDVKEHIDEFIHASMDEHKTCFKKTIQKMFGMSKAVAERSAAAKEAEVESALPLKTSVSQ

SEQ ID NO: 6168 - protein, 96 aa, Secale cereale
MDSGNTQTEGSQPPVPKNPAMTSCRKKKTDDDVTFLEDVKEHIDEFIHASMDEHKTCFKKTIQKMFGLSKVVAERSAAAKEAEVESALPLQTSVSQ

SEQ ID NO: 6169 - protein, 95 aa, Triticum aestivum
MDSGNTQTEGSQPLPKNPAMTSCRKKKTDDDVTFLEDVKEHIDEFIHASMDEHKTCFKKTIQKMFGMSKVVAERSAAAKEAEVESALPLQTSVSQ

SEQ ID NO: 6170 - protein, 95 aa, Brachypodium distachyon
MDSSNTQPEGSRPSVTKNPAMSSCRKKKTDDATFLEDVKDHIDEFINASMDEHKTCFKKTIQKMFGMSKIVADRSAAAKEAEVESVLPLQTSVSR

SEQ ID NO: 6171 - protein, 98 aa, Secale cereale
MDSSNTQSEGSQPPVPPKNPTMSSCRKKKTDDDATFLEDVKEHIDEFIHASVDEHKTCFKKTIQKMFGMSKAVAERSAAAAKEAEVESALPLETSVSQ

SEQ ID NO: 6172 - protein, 97 aa, Cynodon dactylon
MDSGSTQPAGSAAPSVPKNPAMTSCRKKKSEEATFLEDVKDHIDEFIHASMDEHKTCFKKTIQKMFGMSKVVAERSAEKAKEAEVESALPLQTSVSQ

SEQ ID NO: 6173 - protein, 129 aa, Pseudoroegneria spicata
MGLQWMLLTCVVGAEAAVAALLTLPAPRAVRAQIVGLTSMLLQPLAAVLPFAAFQLLDIYWKNEHRLICTGEMCTSEERVRFEKSIFKSQRNVILCVSVFILYWSIYRICKFNKDIKALEEVEKRIKEE

SEQ ID NO: 6174 - protein, 96 aa, Hordeum vulgare
MDSSNTQSEGSQPHVPKNPSMSSCRKKKTDDDATLLEDVKEHIDEFINASMDEHKTCFKKTIQKMFGMSKAVAERSAAAKEAEVESALPLETSVSQ

SEQ ID NO: 6175 - protein, 96 aa, Triticum aestivum
MDSGNTQTDGSQPAAPKNPAMTSCRKKKTDDDVTFLEDVKEHIDEFIHASMDEHKTCFKKTIQKMFGMSKVVAERSAAAKEAEVESALPLQTSVSQ

SEQ ID NO: 6176 - protein, 203 aa, Panicum virgatum
SIVEQSRAESSSTHPRSPTPIRSAIFRAWPSCPAHGIRRCPADAAAGAGRRRIVVAVDEGEESAHALAWCLANVVSPAGGDTLVLVHARRPPPVYAAMDSAGYMLTSDVLASVERHASAVSAAAVDKARRLCAGHPHVAVETLVESGDPRDVICDAADKVGADLLVMGSHGYGFIQRAFLGSVSNHCAQNCKCPVLIVKRPKE

SEQ ID NO: 6177 - protein, 168 aa, Setaria italica
MASAAPPATAAAGAGRRIVVAVDEGEESVHALTWCLANVVSPAGGDTLVLVHARRSRPVYAAMDSAGYIMTSDVLASVERHATAVSAAAVDKAKRICAEHPHLAVETLVESGDPRDVICDATDKVGADLLVMGSHGYGFIQRAFLGSVSNHCAQNCKCPVLIVKRPKE

SEQ ID NO: 6178 - protein, 162 aa, Pennisetum glaucum
MASRAAIAGRRIVVAVDEGEESMHALTWCLANVVSPADGDTVVLVHARRPRPVYAAMDSAGYMMTSDVLASVERHASAVSAAAVDKAKRLCAEHPQVAVETLVEGGDPRDVICDAAGKVGADLLVMGSHGYGFIQRAFLGSVSNHCAQNCKCPVLIVKRPKE

SEQ ID NO: 6179 - protein, 314 aa, Sorghum bicolor
MGHCSEQRTGFEVTKDWNGADQVAIRSPRGASVRVCLHGGQVVSWRNHRGEELLFSSSKAIFKPPKATRGGIPICFPQFGNCGTLEQHGFARNKIWTIDDEAPPLNSGDNNNNKASVDLLLKPSEDDLKCWPHCFELRLRVSLSMDGDLSLISRVRNVNGKPFSFAFAYHTHLSVSDISEVRIEGLETLDYLDNLSQRERFTEQGDAITFESEVDRVYVGCPGVIAVLDHEKKRTFIIRKEGLPDIVVWNPWEKKSKTMTDFGDDEYKQMLCVDAAAVERTITLKPGEEWTGKLELSAVASTNCSDHLDHPGRL

SEQ ID NO: 6180 - protein, 313 aa, Setaria italica
MGHCSEQRPGFEVTKDWNGADQVAIRSPRGASVRVCLHGGQVVSWKNDRGEELLFTSSKAIFKPPKATRGGIPICFPQFGNCGTLEQHGFARNKIWTIDEEAPPLNYGDNNNKASVDLLLKPSEDDLKCWPHCFELRLRVSLSMDGDLSLISRVRNVNGKPFSFAFAYHTYLSVSDISEVRIEGLETLDYLDNLSQRERFTEQGDAITFESEVDRVYVGSPGVIAVLDHEKKRTFIIRKEGLPDIVVWNPWEKKSKTMADFGDDEYKQMLCVDAAAVERAITLKPGEEWTGKLELSAVPSTNCSDHLDHPGRL

SEQ ID NO: 6181 - protein, 314 aa, Panicum virgatum
MGHCSEQWPGFEVTKDWNGADQVAIRSPRGASVRVCLHGGQVVSWRNDRGEELLFTSSKAIFKPPRATRGGIPICFPQFGNCGTLEQHGFARNKIWTIDEEAPPLNYGDNNNNKASVDLLLKPSEDDLKCWPHCFEIRLRVSLSTDGDLSLISRVRNVNGKPFSFAFAYHTYLSVSDISEVRIEGLETLDYLDNLNQRERFTEQGDAITFEAEVDRVYVGSPGVIAVLDHEKKRTFIVRKEGLPDIVVWNPWEKKSKTMADFGDDEYKQMLCVDAAAVERAITLKPGEEWTGKLELSAVPSTNCSDHLDHPGRL

SEQ ID NO: 6182 - protein, 312 aa, Oryza sativa
MGHYSEQRPGFEVTKDWNGADQVMIRSPRGASVLVSLHGGQVVSWRNDRGEELLFTSSKAIFKPPKAMRGGIPICFPQFGNCGTLEQHGFARNRLWAIDDEAPPLNHNDNNGKVSVDLLLKPSEDDLKCWPHCFEFRLRVSLSTDGDLSLVSRVRNVNGKPFSFSFAYHTYLSVSDISEVRIEGLETLDYLDNLSQRERFTEQGDAITFESEVDRVYVGSPSVIAVLDHEKKRTFIVRKEGLPDVVVWNPWDKKSKTMADFGDEEYKQMLCVDAAAVERAITLKPGEEWTGKLELSAVASTNCSDHLDYPCS

SEQ ID NO: 6183 - protein, 245 aa, Brachypodium distachyon
MRGGIPICFPQFGNCGTLEQHGFARNRLWAIDDEAPPLNHNDNNGKVSVDLLLKPSEDDLKCWPHCFEFRLRVSLSTDGDLSLVSRVRNVNGKPFSFSFAYHTYLSVSDISEVRIEGLETLDYLDNLSQRERFTEQGDAITFESEVDRVYVGSPSVIAVLDHEKKRTFIVRKEGLPDVVVWNPWDKKSKTMADFGDEEYKQMLCVDAAAVERAITLKPGEEWTGKLELSAVASTNCSDHLDYPCS

SEQ ID NO: 6184 - protein, 262 aa, Pennisetum glaucum
MSHPHQQQGNLKPPKATRGGIPICFPQFGNCGTLEQHGFARNKIWTIDEEAPPLNYGDNNNKASVDLLLKPSEDDLKCWPHCFELRLRVSLSMDGDLSLISRVRNVNGKPFSFAFAYHTHLSVSDISEVRIEGLETLDYLDNLSQRERFTEQGDAITFESEVDRVYVGSPGVIAVLDHEKKRTFIIRKEGLPDIVVWNPWEKKSKTMADFGDDEYKQMLCVDAAAVERAITLKPGEEWTGKLELSAVPSTNCSDHLDHPGRL

SEQ ID NO: 6185 - protein, 317 aa, Oryza sativa
MGHYTNLTDPRTELEVVRDWNGVDQVVLRSPRGAYARVSLHGGQVLSWRNDRGEELLFTSSKAIFKPPKAMRGGIPICFPQFGNSGTLEQHGFARNRIWALDEEHPPLNQNDNNSKASVDLILKPSEDDLKCWPHGFEFRLRVSLTKDGNLSLVSRIRNVNGKPFSFSFGYHTYLSVSDISEVRIEGLETLDYLDNLSQRERFTEQGDAITFESEVDRVYVSSPNVIAVLDHEKKRTFVIRKEGLPDVVVWNPWEKKSKNIVDFGDEEYKQMLCVDAAAAERQITLKPGEEWTGKLELSEVPSTNCSGHLDQPGIII

SEQ ID NO: 6186 - protein, 354 aa, Sorghum bicolor
MAAESENSNCNAWAARDPSGVLSPYSFNRRAVQSNDVALKIIYCGVCYADVAWTRNVLNDSKYPLVPGHEIAGVVTQVGADVKGFKVGDHVGVGTYVNSCRDCENCNSSLENHCPKAVYTFNGIDTDGTVTMGGYSTHIVVHARYCFQIPDGYPLAKAAPLLCAGITVYTPMMRHNMNQPGKSLGVIGLGGLGHMAVKFGKAFGLKVTVFSTSESKRDEAINLLGADNFVISSDTQQMESLKNSLHFIVDTASGDHPFDPFLSLLKAGGVMTVVGSPSEIKMQPASLILGARTLSGSLVGGTKDIQEMVNFCAANKIYPKIEVIRIDYINEALARLVNRDVKYRFVIDIENSFK

SEQ ID NO: 6187 - protein, 354 aa, Sorghum bicolor
MAAESENGNCNAWAARDPSGVLSPYTFNRRAVQSSDVALKIIYCGVCYADVKWTRNMQHDSKYPLVPGHEIAGVVTQVGADVKGFKVGDHVGVGTYVNSCRDCENCNLSLENHCPKGVYTFNGIDTDGTVTKGGYSTHIVVHERYCFQIPDGYPLAKAAPLLCAGITVYTPMMRHNMYQPGKSLGVIGLGGLGHMAVKFGKAFGLKVTVLSTSESKRDEAITLLGADNFVISSDTQQMESLKNSLHFIVDTASGDHPFDPYLSLLKVGGVMAIVGFPSEIKMHPASLNLGARTLSGSLVGGTKDIQEMVNFCAENKIYPEIEIIKIDYINEALARLVNRDVKYRFVIDIENSFK

SEQ ID NO: 6188 - protein, 354 aa, Sorghum bicolor
MAAESENGNCNAWAARDPSGVLSPYTFNRRAVQSSDVALKIIYCGVCYADVKWTRNMQHDSKYPLVPGHEIAGVVTQVGADVKGFKVGDHVGVGTYVNSCRDCENCNLSLENHCPKGVYTFNGIDADGTVTKGGYSTHIVVHERYCFQIPDGYPLAKAAPLLCAGITVYTPMMRHNMYQPGKSLGVIGLGGLGHMAVKFGKAFGLKVTVLSTSESKRDEAITLLGADNFVISSDTQQMESLKNSLHFIVDTASGDHPFDPYLSLLKVGGVMAIVGFPSEIKMHPASLNLGARTLSGSLVGGTKDIQEMVNFCAENKIYPEIEIIKIDYINEALARLVNRDVKYRFVIDIENSFK

SEQ ID NO: 6189 - protein, 354 aa, Saccharum officinarum
MAAESENGNCNAWAARDPSGVLSPYKFNRRAVQNNDVALKIIYCGVCYADVGWTRNMHNDSKYPLVPGHEIAGVVTQVGADVKGFKVGDHIGVGTYVNSCRDCENCNSSLENHCPERVFTFNGIDTDGTVTMGGYSTHIVVHERYCFKIPNGYPLAKAAPLLCAGITVYTPMMRHNMNQPGKSLGVIGLGGLGHMAVKFGKAFGLKVTVLSTSESKRHEAISLLGADNFVISSDTQQMESLKNSLHFIVDTASGDHPFDPYLSLLKVGGVMAIVGFPSEIKMHPASLNLGARTLSGSVTGGTKDIQEMVNFCAANKIYPEIEIIKIDYINEALTRLVNRDVKYRFVIDIENSFK

SEQ ID NO: 6190 - protein, 354 aa, Sorghum bicolor
MAAESEHGNCNAWAARDPSGVLSPYSFNRRPVQSSDVALKILYCGVCYADVVWTRNMHHDSKYPVVPGHEIAGVVTQVGADVKGFKVGDHVGVGTYVNSCRDCENCNSSLENHCPKGVYTFNGIDTDGTVTKGGYSTHIVVHERYCFQIPDGYPLAKAAPLLCAGITVYTPMMRHNMNQPGKSLGVIGLGGLGHMAVKFGKAFGLKVTVLSTSESKRHEAISLLGADNFVISSDTQQMESLRNSLHFIVDTASGDHPFDPYLSLLMVGGVMAIVGFPSEIKMHPASLNLGARTLSGSVTGGTKDIQEMVNFCAANKISPEIEIIKIDYINEALTRLVNRDVKYRFVIDIENSFK

SEQ ID NO: 6191 - protein, 354 aa, Panicum virgatum
MASESGDGNCDAWAARDPSGVLSPYKFNRRAVQSDDVSLKITHCGVCYADVIWTQNRLNDSKYPLVPGHEIAGVVTEVGSDVKGFKVGDHVGVGTYVNSCRDCENCNSSLENHCPRSVYTFNGIDTDGTVTKGGYSTHIVVHERYCFKIPDGYPLAKAAPLLCAGITVYTPMMRHNMNQPGKSLGVIGLGGLGHMAVKFGKAFGLKVTVFSTSESKRDEAINLLGADNFVISSNTQQMESLKNSLHFIVDTASGDHAFDPYLSLLKVGGVMAIVCFPSEIKVHPASLNIGARTLSGSITGGTKDIQEMVNFCAANKIYPEVEIIKIDYINEALTRLVNRDVKYRFVIDIENSFK

SEQ ID NO: 6192 - protein, 354 aa, Pennisetum glaucum
MASESGDGNCNAWAARDPSGVLSPYKFDRRAVQSGDVSLRITHCGVCYADVVWTQNRHNDSKYPLVPGHEISGVVTEVGSDVKGFKVGDHIGVGTYVNSCRDCENCNSSLENYCPKSVYTFNGIDTDGTVTKGGYSTHIVVHERYCFKIPDGYPLAKAAPLLCAGITVYTPMMRHNMNQPGKSLGIIGLGGLGHMAVKFGKAFGLKVTVFSTSESKRDEAINILGADNFVISSNTQQMESLKNSLHFIVDTASGDHPFDPYLSLLKIGGVMAVVGFPSEIKVHPASLNLGGRTLSGSIVGGTKDIQEMVNFCAVNKIYPEIEIIKIDYINEALKRLVNRDVKYRFVIDIENSFK

SEQ ID NO: 6193 - protein, 354 aa, Zea mays
MAAAAEHGNCDAWAARDPSGVLSPYKFNRRAVQSSDVSLKIIYCGVCYGDVMWIQNKHNDSVYPLVPGHEIAGVVTEVGADVKAFKVGDHAGVGTYVNSCRHCENCNSSLENYCPETVFTYNTTDADGTITKGGYSTHIVVHERYCFKIPDGYPLAQAAPLLCAGITVYTPMARHNMKQPGKSLGVIGLGGLGHMAVKFGKAFGLKVTVFSTSESKREEAINLLGADNFVISSDTQQMEALKNSLHFIVDTASGDHPFDPYLSLLKVGGVMTIVCFPSEIKMHPASLNRGGRTLSGSIVGGTKDIQEMVNFCAENKIYPEIEIIKMDYINEALARLVNRDVKYRFVIDIKNSFE

SEQ ID NO: 6194 - protein, 100 aa, Setaria italica
MASESGDGNCNAWAARDPSGVLSPYKFDRRAVQSGDVSLKITHCGVCYADVVWTQNMHNDSKYPLVPGHEIAGVVTEVGSDVKGFKVGDHIGIGTYVTSC

SEQ ID NO: 6195 - protein, 354 aa, Oryza sativa
MAAECGSGNCDAWAARDPSGILSPYKFNRRAVQSDDVSLRITHCGVCYADVAWTRNILNNSMYPLVPGHEIAGVVTEVGADVKSFKVGDHVGVGTYVNSCRDCENCNSSLENYCSQHVFTFNGVDTDGTVTKGGYSTHIVVHERYCFKIPDGYPLEKAAPLLCAGITVYSPMMRHNMNQPGKSLGVIGLGGLGHMAVKFGKAFGLKVTVISTSESKRKEAIDLLGADNFVVSSDENQMETLKSSLNFIIDTASGDHPFDPYLTLLKVGGVMALLSFPSEIKVHPANLNLGGRSLSGSVTGGTKDIQEMINFCAANKIYPDIEMIKIDYINEALQRLVDRDVRFRFVIDIENSFK

SEQ ID NO: 6196 - protein, 348 aa, Cynodon dactylon
MACDSKSGNCNAWAARDPSGLLSPYNFNRRSVQSGDVSLKITHCGVCYADVIWTRNMHNDSKYPLVPGHEIAGVVTEVGSDVKTFKIGDHVGVGTYVNSCQDCENCNNFLENHCSKNVYTFNAIDTDGTITKGGYSTHIVVHERYCFKIPDGYPLEKAAPLLCAGITVYTPMMRHNMNQPGKSLGVIGLGGLGHMAVKFGKSFGLKVTVFSTSESKRDEAINLLGAENFVISSNTQQMESLKNSLHFIVDTAAGDHAFDPYLSLLKVGGVMALVGFPSEIKVHPANLNLGARTLAGSVTGGTKDIQEMLDFCASNRIYPETEIIQMDYINEALKRLVNRDVKSRFVID

SEQ ID NO: 6197 - protein, 83 aa, Setaria italica
MASESGDGNCNAWAARYPSGVLSPYKFNRRSVQSSDVSLKITHCGVCYAVIWTRNKHNNSKYPLFPGHEIAGVVTEVGSDVSG

SEQ ID NO: 6198 - protein, 240 aa, Secale cereale
MAAESESCNCSAWAAKDPSGLLSPHSFNRRAVRHDDVSLRITHCGVCYADVQWTRNLHHDSVYPLVPGHEIAGVVTEVGLDVKGFKLGDHVAVGTYINSCRDCDNCSSLLENHCSNFVFTFNGVDTDGTVTKGGYSTHIVVHERYCYKIPDGYPLEKAAPLVCAGITVYTPMMRHNMNQPGKSLGVIGLGGLGHMAVKFGKAFGLNVTVLSTSESKRDEAINLLGADNFVVSSDKTRWSP

SEQ ID NO: 6199 - protein, 354 aa, Brachypodium distachyon
MAAECESGNCHAWAAKDPSGTLSPYKFNRRTVQSGDISLRITHCGVCYADVIWTRNQHNDSVYPLVPGHEIAGVVTEVGSDVNGFKVGDHVCVGTYVNSCRDCENCNSFLENHCSKFVFTFNGVDTDGTVTKGGYSGHIVVHERYCYKIPDGYPLEKAAPLVCAGITVYTPMIRHNMNQPGKSLGVIGLGGLGHMAVKFGKSFGLKVTVFSTSESKREEAISLLGADNFVISSDKKQMESLKSSLHFIVDTASGNHPFDPYLSLLKVGGVMALLSFPEEIRIHPATLNLGARTLAGSVTGGTKDTQEMINFCAANKIYPDIELIKIDYINEALGRLVNRDVRYRFVIDIENSFK

SEQ ID NO: 6200 - protein, 365 aa, Sorghum bicolor
MGHLSEHFRSDGISRNLSANSNVLVFLFSYCSWSVKLNYETDAYYGALSEHFRAVQSSDVALKIIYCGVCYADVGWTRNMLNDSKYPLVPGHEIAGVVTQVGADVKAFKVGDHVGVGTYVNSCRDCENCNSSLENHCPERVFTFNGIDTDGTVTKGGYSTHIVVHERYCFKIPDGYPLAKAAPLLCAGITVYTPMMRHNMNQPGKSLGVIGLGGLGHMAVKFGKAFGLKVTVLSTSESKRHEAISLLGADNFVISSDTQQMESLKNSLHFIVDTASGDHPFDPYLSLLKVGGVMTLLGFPSARALSGSVVGGTKDIQEMVNFCAENKIYPEIEIIKIDYINEALARLVNRDVKYRFVIDIENSFK

SEQ ID NO: 6201 - protein, 365 aa, Sorghum bicolor
MGHLSEHFRSDGISRNLSANSNVLVFLFSYCSWSVKLNYETDAYYGALSEHFRAVQSSDVALKIIYCGVCYADVGWTRNMLNDSKYPLVPGHEIAGVVTQVGADVKAFKVGDHVGVGTYVNSCRDCENCNSSLENHCPERVFTFNGIDTDGTVTKGGYSTHIVVHERYCFKIPDGYPLAKAAPLLCAGITVYTPMMQHNMNQPGKSLGVIGLGGLGHMAVKFGKAFGLKVTVLSTSESKRHEAISLLGADNFVISSDTQQMESLKNSLHFIVDTASGDHPFDPYLSLLKVGGVMTLLGFPSARALSGSVVGGTKDIQEMVNFCAENKIYPEIEIIKIDYINEALARLVNRDVKYRFVIDIENSFK

SEQ ID NO: 6202 - protein, 579 aa, Saccharum officinarum
MGKSPAKWIKSVLFGKKSSSRSGSTKAKDLSKGASNKGYAADGKEPAFSESSPVISEPVLVSAHNNETAREVARGENSSVQEEVPVTDVSQDLEKQGTVGSDTSNDAERLREEQAAVKAQAAFRGYLARRAFRALKGIIRLQALIRGHLVRRQAVSTLRATWLIVKFQALVRGRNVRLSQASIQATRELSQQKFRDAKPCSWKEKLSSNAFARKLLSSPIVVEALHFQYDEMDPNSAFNWLERWTISHVWKPISQPKRVGADAKPHTRKASYAMETESAKLKRNARKSSLVPFEPSQTNTAIEIEKTRRNPRKLSSTPAESVPDGQLTELEKVKRSLRKVTNSVAETSKTPNPTTEIPDHQEVQCERPLRSAKQVPIHPENQEPRNVNLSDNAKMDILVPDIQPDVEVASDPVTITNEEKVDEPPSVVAPAAEIMPLQDINNEENALVNDVEERSKEEHPSTESLKGSKRRSSFSTKPEYPENGSKNSPALPSYMAATQSAKAKLRGNSSPRLSSDSAEKNGFTRRHSLPSSNNGKMISHSPRTQRPTHAGGKDGAKGDKAMLSSRDASERPLKAEWRR

SEQ ID NO: 6203 - protein, 579 aa, Sorghum bicolor
MGKSPAKWIKSVLFGKKSSSRSGSAKAKDLSKGASNKGYAAAGKEPAFSESSPVISEPVLVSAHNDETAREVAKAENSSVQEEVPVTDVCQDLEKQGAVGSDSSNDADRVREEQAAVKAQAAFRGYLARRAFRALKGIIRLQALIRGHLVRRQAVSTLRATWLIVKFQALVRGRNVRLSQAFIQATRELSLEKFGGAKPGSWKEKLSSNAFARKLLSSPIVVEALHFQYDEMDPNSAFNWLERWTISHVWKPISQPKRVGADAKPHTRKASYAMETESAKLKRNARKSSAVPSEASQTNTTIEIEKTRRNPRKLSSTPAESVPDGQLTELEKVKRSLRKVTNSMAETSKTPNPTTEIPDPQEVQCERPLRSAKQVPIHPENQDPRNVNLSDNSKIDILVPDIQPDVEDASDPVTITNEEKVDEPPSVVAPVAEIMPLQDINNEENALVNDVEERSKEEHPSTESLKGSKRRSSFSTKPEYPENGSKNSPALPSYMAATQSAKAKLRGSSSPRLSSDSAEKNGFTRRHSLPSSNNGKMISHSPRTQRPTLAGGKDGAKGDKAMLSSRDASERPLKAEWRR

SEQ ID NO: 6204 - protein, 578 aa, Zea mays
MGKSPAKWIKSVLFGKKSSSRSGSTKAKDLSKGASNKGAAAAGKEPVFSESSPVISEPVLVSAHNNETVREVAKGENSSVQEVPVTDVSQDLEKQGSVGSDTSNDAERVKEERAAVKAQAAFRGYLARRAFRALKGIIRLQALIRGHLVRRQAVSTLRATWLIVKFQALVRGRNLRLSEASIQATMELSQQNLAGAKPGSWKEKLSSNAFARKLLSSSIVVEALHFQYDEMDPNSAFNWLERWTISHVWKPASQPRRVSADAKPHTRKASYAMETESVKLKRNARRSSAGPFEPSQTNTAIEIEKTRRNPRKLSSTPAESVPDGQLTELEKVKRSLRKVTNSVAETSKASSPKTEIPNHQEVQCERPLRRAKQVPIHLENQEPDNVNLSDNAKMDILVPDIQPDVEVASDPVTITNEENVDEPPSVVAPVAEIMPLQDINNDENALVNDVEERSKEEHPSTESLKGSKRRSSFSAKPEYPENGSKNSPALPSYMAATQSAKAKLRGNSSPKLSSDSAEKNGFTRRHSLPSSNNGKMVSHSPRTQRPANAGGKDGAKGDKAMLSSRDASERPLKAEWRR

SEQ ID NO: 6205 - protein, 574 aa, Setaria italica
MGKSPAKWIKSVLFGKKSSSRSGSTKAKDLSKGASNKGYAGKEPAFSESSPVISEPVLVSAHNNEAVREVPKGENSSVQGEVAVPDVNQDLEKHDTVGSDASNDAERLREEQAAVKAQAAFRGYLARRAFRALKGIIRLQALIRGHLVRRQAVSTLRATWLIVNFQALIRGRNVRLSQAAIHASRKLTQQNFGGAKPDLWKEKLSSNAFARKLLSSPIVVEALHFQYDEMDPNSAFNWLERWTISHVWKPISQPKRVGTDAKPHARKASYAMETESAKLKRNARKSSATPFEPSQTNTTTEIEKTKRIPRKMSSAPADSVPDGQLTELEKVKRSLRKVTNSMAETSKVSNPAPEIPDDQEVRCDRPLRSAKQVPVHPESQEPQNVNLLDNAKMAILVPDLQPDEEIASDPVINEEKVDELSVVTPPAEIMPLQDINNEENALVNDTEQRSKEEPLSTESLKGSKRRSSFSTKPEYPENGSKNSPALPSYMAATQSAKAKLRGQNSPRLSSDSAEKNGFTRRHSLPSSTNGKMVSHSPRTQRPTNAGGKDGAKGDKAMLSSRDASERPLKAEWRR

SEQ ID NO: 6206 - protein, 574 aa, Panicum virgatum
MGKSPAKWIKSVLFGKKSSSRSTSTKSKDLSKGASNKGYAGKEPAFSESSPVISEPVLVSAHNTETAREVAKGENSNVQGEVAVPDVNHDLEKHVSVGSDASNDAERLREEQAAVKAQAAFRGYLARRAFRALKGIIRLQALIRGHLVRRQAVSTLRATWLIVKFQALIRGRNVRLSQAAIHASRKLTQQNFGSAKPDSWKEKLSSNAFARKLLSSPIVVEALHFQYDEMDPNSAFKWLERWTTSRIWKAISQPKRVGADAKPHAKKASYAMETESGKLKRNARKSSAMPFEPSQANTSIEIEKTKRNPRKPSSAPADSVPDGQLTELEKVKRSLRKVTNSMPETSKVSNPAPEIPDHQEVQSERPLRSAKQVPVHPENQEPQNVKLSDNAKIDILVPDLQPDEEVASDPVTNDEKVDEPTVVAPPAEIMPLQDINNEENALVNDTEQRSKEEPLSTESLKGSKRRSSFSTKPEYPENGSKNSPALPSYMAATQSAKAKLRGQNSPRLGSDSAEKNGFTRRHSLPSSTNGKMIAHSPRTQRPTHAGGKDGAKGDKTMLSSRDASERPLKAEWRR

SEQ ID NO: 6207 - protein, 576 aa, Pennisetum glaucum
MGKSPAKWIKSMLLGKKSSSRSGSTKAKDLSKGASNKGYAGKEPAFSESSPVISEPVLVSAHNNEAAREVPKGENSSVQGEVAVTDVNQELEKHDTVGSYVSNDAERLREEQAAVKAQAAFRGYLARRAFRALKGIIRLQALIRGHLVRRQAASTLRATWLIVKFQALIRGRNVRLSQAAIHACRKLTQQNFGGAKPDSWKGKLSSNAFARKLLSSPIVVEALHFQYDEMDPNSAFNWLERWTISYVWKPISQPKRVGTDAKPHARKASYAMETESAKLKRNARKSSASATPFDPSQTNTTTEVEKTKRVPRKMSSAPADSVPDGQLTELEKVKRSLRKVTNSIAETSKVPNPAPETPDHQEVQCERPLRSAKQVPVHLENQEAQNVSLPDNAKTAILVPDLQPDQEIASDPVTNEEKVDEQSVVTPPAEIMPLQDINNEENTLVNDMEQRSKEEPLSTETLKGSKRRSSFSTKPEYPENGSKNSPALPSYMAATQSAKAKLRGQNSPRLSSDSAEKNGFTRRHSLPSSTNGKVVSHSPRTQRPSHAGGKDGAKGDKAMLSSRDASERPLKAEWKR

SEQ ID NO: 6208 - protein, 573 aa, Panicum virgatum
MGKSPAKWIKSVLFGKKSSSRSTSTNSKDLSKGASNKGYAGKEPAFAESSPVISEPVLVSAHNNETVREVAKGENSNSQGEVAVPDVNQDLEKHVTVGSDASNDAERLREEHAAVKAQAAFRGYLARRAFRALKGIIRLQALIRGHLVRRQAVSTLRATWLIVKFQALIRGRNARVSQAAIHASWKLTQQNFGSAKPDSWKEKLSSNAFARKLLSSPIVVEALHFQYDEMDPNSAFNWLERWTTSHVWKPISQPKRIGADAKPHAKKASYAMETESGKLKRNARKSSATPFEPSQTNISIEIEKTKRNPRKPSPPADSVPDGQLTELEKVKRSLRKVTNSMAETSKVSNPAPEIPDHQEVQSERPLKNAKQVQVHSENQEPQNVKLSDNAKIDILVPDLQPDEEVASDPVTNDEKVDEPTVVAPPAEIMPLQDINNEENALVNDTEQRSKEEPLSTESLKGSKRRSSLSTKSEYPENGSKNSPALPSYMAATQSAKAKLRGQNSPRLSSDSAEKNGFTRRHSLPSSTNGKMIAHSPRTQRPTHAGGKDGAKGDKAMLSSRDLSERPLKAEWRR

SEQ ID NO: 6209 - protein, 665 aa, Saccharum officinarum
MAAEEGAMSPTRMLAEGHLRVATGGGTPADGGIAVRHLPHHHSTKKDGVGGKTEQDNHEGVDSLPSQELKKLANGNSKIPGTLDDYRKLVVPIIEEYFSTGDVELASSELRGLGSDQFQHYFVKKLISMAMDRHDKEKEMASILLSSLYADLLSSYTISEGFMMLLESTDDLTVDIPDATDVLAVFIARAIVDEILPPVFLTRARALLPEFSKGIQVLQVVEKSYLSAPHHAEVVERKWGGSTHFTVEEAKRRIQNILREYIESGDIDEAFRCIRELSLPFFHHEVVKRALTFGMENISSQPLILKLLKEAAAGCLISPNQISKGFSRLAEGVDDLSLDIPSAKALFDKLVSTAISEGWLDASFGKSAAPDEEMQNTSAVKVKRFKEESGHIIHEYFLSDDVPELIRSLEELSAPEFNPIFLKKLVTLAMDRKSREKEMASVLLSSLRLELFSTEDIMKGFVMLLQSAEDTALDIVDAPSELALFLARAVIDEVLIPLNLDEISIKLRPNSSGSQTVQMARALLSARHSGERILRCWGGGTGWAVEDAKDKITKLLEEYNTGGDLGEACRCIRDLGMPFFNHEVVKKALVMAMEKHSDTSILALLQECFGEGLITINQMTKGFARVKEGLDDLILDIPNAQEKFGEYVELATERGWLLPTFASIT

SEQ ID NO: 6210 - protein, 665 aa, Sorghum bicolor
MAAEEGAMSPTRMLAEGHLRVATGGGAPADGGIAVRHLPHHHPTKKDGVGGKTEQDNHEGVDFLPSQELKKLANGNSKIPGTLDDYRKLVVPIIEEYFSTGDVELAASELRGLGSDQFQHYFVKKLISMAMDRHDKEKEMASILLSSLYADLLSSYTISQGFMMLLESTEDLTVDIPDATDVLAVFIARAIVDEILPPIFLTRARALLPEFSKGIQVLQVVEKSYLSAPHHAELVERKWGGSTHFTVEEAKRRIQNILREYIESGDIDEAFRCIRELSLPFFHHEVVKRALTFAMENISSQPLILKLLKEAAAGCLISPNQISKGFSRLAEGVDDLSLDIPSAKALFDKLVSTAMAEGWLDASFGKSAAPDEEMQNTSAVKMKHFKEESAHIIHEYFLSDDVPELIRSLEELSAPEFNPIFLKKLVTLAMDRKSREKEMASVLLSSLRLELFSTEDIMKGFIMLLQSAEDTALDIVDAPSELALFLARAVIDEVLIPLNLDEISIKLRPNSSGSQTVQMARALLSARHSGERILRCWGGGTGWAVEDAKDKITKLLEEYNTGGDLGEACRCIRDLGMPFFNHEVVKKALVMAMEKQNDTSILALLQECFGEGLITINQMTKGFARVKEGLDDLVLDIPNAQEKFGEYVELATEHGWLLPTFESIP

SEQ ID NO: 6211 - protein, 665 aa, Setaria italica
MAAEEGAMSPTRMLAEGHLRVATGGGAPADGGIAVRHLPHHHPAKKDGVGGKTEQDNHEDVDSLPSQELKKLANGNNKVPGTLDEYKRLVVPIVEEYFSTGDVELASSELRSLGSDQFQHYFVKKLISMAMDRHDKEKEMASVLLSSLYADLLSSYMISEGFMMLLESIEDLTVDIPDAVDLLAVFIARAVVDEILPPVFLARARALLPEFSKGIQVLQVVEKSYLSAPHHAELVERKWGGSTHFTVEEAKKRIQDILREYIESGDIDEAFRCIRELSLPFFHHEVVKRALTLGMENISSQPLILKLLREAAAGCLISSNQISKGFSRLAESVDDLSLDIPSAKDLFDKLVSTAISEGWLDASFSKSAASEEEMRNTSADKVKRFKEESGHIIHEYFLSDDVPELIRSLEELSAPEYNPIFLKKLVTLAMDRKNREKEMASVLLSSLSLELFSTDDIMKGFIMLLQSAEDTALDIVDAPSELALFLARAVIDEVLIPLNLDEISSKLRPNSSGSQTVQMARALLSARHSSERILRCWGGGTGWAVEDAKDKIAKLLEEYSTGGDLGEACRCIRDLGMPFFNHEVVKKALVMAMEKQNDAGILALLQECFGEGLITINQMTKGFTRVKEGLDDLVLDIPNAQEKFGAYVELATGRGWLLPAFTSVP

SEQ ID NO: 6212 - protein, 665 aa, Panicum virgatum
MAAEEGAMSPTRMLAEGHLRVATGGGAPADGGIAVRHLPHHHPAKKDGVGGKTEQDNHEDVDSLPSQELKKLANGNNKVPGTLDGYKRLVVPIVEEYFSTGDVELAACELRGLGSDQFQHYFVKKLISMAMDRHDKEKEMASVLLSSLYADVLSSYMISEGFIMLLESIEDLTVDIPDAVDVLAVFIARAVVDEILPPVFLARARALLPEFSKGIQVLQVVEKSYLSAPHHAELVERKWGGSTHFTVEEAKKRIQGILREYIESGDIDEAFRCIRELSLPFFHHEIVKRALTYGMENISSQPLILKLLKEAAAGCLISSNQMSKGFSRLAESVDDLSLDIPSAKDLFDKLVSTAISEELLDASFSKSAVSEEEMQNTSAEKVKRFKEESGHIIHEYFLSDDVPELIRSLEELSAPEYNPIFLKKLVTLAMDRKNREKEMASVLLSSLSLELFSTDDIMKGFIMLLQSAEDTALDIVDAPSELALFLARAVIDEVLIPLNLDEISSRLRPNSSGSQTVQMARSLLSARHSGERILRCWGGGTGWAVEDAKDKITKLLEEYNTGGDLGEACRCIRDLGMPFFNHEVVKKALVMAMEKQDDASILALLQECFGEGLITINQMTKGFTRVKDGLDDLVLDIPNVQEKFGAYVELATGRGWLLPTFASVP

SEQ ID NO: 6213 - protein, 508 aa, Avena sativa
MSEGFMMLLESTEDLSVDIPDAIDVLAVFIARAVVDEILPPVFLTRARALLPESSKGVEVLQVAEKSYLSAPHHAELVERKWGGSTYFTVEEAKKKIQNILREYIESGDTDEAFRCIRELGLPFFHHEVVKRALIFGMENPSSQPLILKLLKESTAGGLISSNQVSKGFSRVAESVDDLSLDVPSAKTLFDKLLSAAISEGWLDASFSKSAASDEDMLNASGEKVKRFKEESGHIIQEYFLSDDVPELIRSLQELSAPEYNAIFLKKLITVAMDRKNREKEMASVLLSSLSLELFSTDDIMKGFVMLLQSAEDTALDIVDAPSELALFLARAVIDEVLVPLNLDDISSKLRPNSSGSQTVQMASSLLAARHSGERILRCWGGGTGWAVEDAKDKISKLLEEYNTGGHLGEACQCIRDLGMPFFNHEVVKKALVMAMDKQNEASILALLQECFGEGLITINQMTKGFARVKEGLDDLVLDIPNAQEKFGAFVELATGRGWLLPSFATAP

SEQ ID NO: 6214 - protein, 665 aa, Brachypodium distachyon
MAAEDGAMSPTRMLAEGHLRVATGGGAPADGGIAVRHLPHHHAAKKEGVGGKIEQDNLGVADPLPSQEFSKLVNGNNKVPGTLDDYRKLVVPVIEEYFSTGDVSLVASELKSLGSDQFHNYFVKKLISMAMDRHDKEKEMASILLSALYADLLGSSKMSEGFMMLLESAEDLSVDIPDAVDVLAVFIARAVVDEILPPVFLARARALLPESSKGIEVLLVAEKSYLSAPHHAELVERKWGGSTYFSVEEAKKRIQDILREYVESGDANEAFRCIRELGLPFFHHEVVKRALILGMENLSSQPLILKLLKESAAGCLITSNQVSKGFARVAESVDDLSLDIPSAKTLFDKLLSAAISEGWLDASFTKSAASDEDMVTASGEKVKRFKVESGHIIQEYFLSDDIPELIRSLQELSAPEYNAIFLKKLITLAMDRKNREKEMASVLLSSLRLELFSTDDIMKGFIMLLQSAEDTALDIVDAPSELALFLARAVIDEVLIPLNLDDISIKLRPNSCGSQTVQMASALLAARHSGERILRCWGGGTGWAVEDAKDKISKLLEEYKTGGDLGEACQCIRDLGMPFFNHEVVKKALVMAMEKQNEASILALLQECFSEGLITINQMTNGFGRVKEGLDDLILDIPNAQEKFGAYVELATGRGWLLPSFASLP

SEQ ID NO: 6215 - protein, 619 aa, Pennisetum glaucum
DGVGGKTEQDNHEDVDSLPSQELKKLANGNNKVPGTLDEYKRLVVPIVEEYFSTGDVELAASELRSLGSDQFHHYFVKKLISMAMDRHDKEKEMTSVLLSSLYADLLSSYMISEGFMMLLESIEDLTVDIPDAVDVLAVFVARAVVDEILPPVFLARARALLPEFSKGIQVLQVVEKSYLSAPHHAELVERKWGGSTHFTVEEAKKRIQDILREYVESGDIDEAFRCIRELSLPFFHHEVVKRALTLGMENISSQPLILKLLREATAGCLISSNQISKGFSRLAETVDDLSLDIPSAKDLFDKLVSKAISEGWLDASFSKSAASEEEIHNTSADKVKHFKEESGHIIHEYFLSDDVPELIRSLEELSAPEYNPIFLKKLVTLAMDRKNREKEMASVLLSSLSLELFSTDDIMKGFIMLLQSAEDTALDIVDAPSELALFLARAVIDEVLIPLNLDEISSKLRPNSSGSQTVQMARALLSARHSGERILRCWGGGTGWAVEDAKDKIAKLLEEYSTGGDLGEACRCIRDLGMPFFNHEVVKKALVMAMEKQNDAGVLALLQECFGEGLITINQMTKGFARVKEGLDDLVLDIPNAQEKFGAYVELATGRGWLLPTFASVP

SEQ ID NO: 6216 - protein, 662 aa, Oryza sativa
MAAEEGARSPTRMLAEGHLRVATGGGAPADGGIAVRHLPHHHASKREGAGGKNEQYNLEDVDSVPSKMSNKLVNGNNKVPATLDDYKRLLVPVIEEYFSTGDVELAASELRSLGSDQFHSYFIKKLISMAMDRHDKEKEMASILLSALYADLLGSSKMSEGFMMLLESTEDLSVDIPDAIDVLSVFVARAVVDEILPPVFLTRARALLPEFSKGIEVLQVSEKSYLSAPHHAELVERKWGGSTHFTVEEAKRRIQDILKEYIESGDIDEAFRCIRELGLPFFHHEVVKRALTLSMENLSSQPLILKLLKESTAGCLISSNQMSKGFCRLAESIDDLSLDIPSAKILFDKLVLTATSEGWLDASFTTSSAPNEDMRNASGEKIKHFKEESGHIIQEYFLSDDVPELIISLQELSAPEYNPIFLKKLITLAMDRKNREKEMASALLSSLSLELFSTDDIMKGFILLLQSAEDTALDIVDAPSELALFLARAVIDEVLIPLNLDEIGNRLRPNSSGSQTVQMARALLAARHSGERILRCWGGGTGWAVEDAKDKIAKLLEEYNTGGDLGEACQCIRDLGMPFFNHEVVKKALVMAMEKENEARILALLQECFGEGLITINQMTLGFTRVKEGLDDLILDIPNAQEKFGAYVDLATERGWLLPPFA

SEQ ID NO: 6217 - protein, 645 aa, Triticum aestivum
IATGGRAPADGGIAVRHIPHHHTAKKEDVGGKIEQDNLGDANLLPSQELGKLVNGTKKVPATLDDYRKLVVPVIEEYFSTGDVELSVSELRSLGSDQFHNYFVKKLISMAMDRHDKEKEMASILLSALYADLLDSSKMSEGFMMLLESTEDLSVDIPDAIDVLAVFVARAIVDEILPPVFLTRARALLPESSKGIEVLQVAEKSYLSAPHHAELVERKWGGSTHFTVEEAKKRIQDILREYIESGDTDEAFRCIRELGLPFFHHEVVKRALILGMENLSSQPLILKLLKESTTGCLISSNQVSKGFSRVADSVDDLSLDVPSAKTLFDKLLSTAISEGWLDASFCKSAAPGEDMWNASNEKVKHFKEESGHIIQEYFLSDDVPELIRSLQELSAPEYNAIFLKKLITLAMDRKNREKEMASVLLSSLSLELFSTGDIMKGFIMLLQSAEDTALDIVDAPSELALFLARAVIDEVLLPLNLDDISSKLRPNSSGSQTVQMASSLLAARHSGERILRCWGGGTGWAVEDAKDKISKLLEEYNTGGDLKEACQCIRDLGMPFFNHEVVKKALVMAMEKQNEASILALLQECASEGLITINQMTNGFARVKEGLDDLTLDIPNAQEKFRGYVELATERGWLLPSFASLP

SEQ ID NO: 6218 - protein, 637 aa, Secale cereale
PADGGIAVRHIPHHHTAKKDVGEKIEKDNLGDANQLPSQELGKLVNGTKKVPATLDDYRKLVVPVIEEYFSTGDVELSVSELRSLGSDQFHNYFVKKLISMAMDRHDKEKEMASILLSALYADLLDSSKMSEGFMMLLESTEDLSVDIPDAIDVLAVFVARAIVDEILPPVFLTRARALLPESSKGIEVLQVAEKSYLSAPHHAELVERKWGGSTHFTVEEAKKRIQDILREYIESGDTDEAFRCIRELGLPFFHHEVVKRALILGMENLSSQPLILKLLKESTTGCLISSNQVSKGFSRVADSVDDLSLDVPSAKTLFDKLLSTAISEGWLDASFCKSAAPDEDMWNASSEKVKHFKEESGHIIQEYFLSDDVPELIRSLQELSAPEYNAIFLKKLITLAMDRKNREKEMASVLLSSLSLELFSTGDIMKGFIMLLQSAEDTALDIVDAPSELALFLARAVIDEVLVPLNLDDISSKLRPNSSGSQTVQMASSLLAARHSGERILRCWGGGTGWAVEDAKDKISKLLEEYSTGGDLKEACQCIRDLGMPFFNHEVVKKALVMAMEKQNEASILALLQECAGEGLITMNQMTNGFARVKEGLDDLTLDIPNAQEKFRGYVELATERGWLLPSFASLP

SEQ ID NO: 6219 - protein, 273 aa, Setaria italica
MRRLRLADALLPLLLALAAGGAATTAAAAAAKAPAAPPAPPNVTAEMAKGGCKAFADLIAASPDASSTYQSAVEGGMTVFCPSDDAVRAFLPKYRNLTADGKAELLLFHAVPVHYSLGSLKSNNGPMNTLATDGAAKNYNFTLQNQGDVVTIRTGASAGAPARVKSTALDKDPLAIYVIDRVVQPVELFKPAPAPTPAPAPAPAADAPKAAGGKPARRPAPAVADAPGPAEDDAAPVDQKKDAKKSAAAAGAPCFRWWLATALAAAAAASTLA

SEQ ID NO: 6220 - protein, 92 aa, Sorghum bicolor
MASRLVAAAAASSSSSASPLARLISRRGLAGAADGHGPAKVPLWKDPLSPSKWKEEHFVLASLSMWGALIYGGFKLFGGKKEDKTEVAPAKA

SEQ ID NO: 6221 - protein, 93 aa, Saccharum officinarum
MASRLVAAAAASSSSSSASPLARLISRRGLAGAADGHGPAKVPLWKDPLSPSKWKEEHFVLASLSMWGALIYGGFKLFGGKKEDKTEVAPAKA

SEQ ID NO: 6222 - protein, 91 aa, Setaria italica
MASRLVAAAASSTSSPLARLVSRRGLAGAADGHGPAKVPLWKDPMSPSKWKEEHFVLASLSMWGAVIYGGIKFFTGGKKEDKAEAAPAQAA

SEQ ID NO: 6223 - protein, 218 aa, Saccharum officinarum
MVLWVFGYGSLIWNPGFDFDDKILGFIKGYKRTFNLACIDHRGTPEHPARTCTLETDDEAICWGIAYCVKGGPEKERKAMQYLERRECEYDQKISIDFYKEGDPLKPAVTGILVFVSTPDPIGNKYYLGSAPLQDMARQIATANGPTGYNRDYLFSMEKALASISHEDDSIIELADEVRKVLNRTKETKITGANASLKSHVPLVHLSALPEGTVVDSR

SEQ ID NO: 6224 - protein, 218 aa, Sorghum bicolor
MVLWVFGYGSLIWNPGFDFDDRILGFIKGYKRTFNLACIDHRGTPEHPARTCTLETDDEAICWGIAYCVKGGPEKERKAMQYLERRECEYDLKISIDFYKEGDPLKPAVTGVLVFVSTPDPIGNKYYLGPAPLQDMAKQIATANGPTGYNRDYLFSMEKALASISHEDESIIELANEVRKVLNKTKETKITGANASLKSHAPLVHLSALPEGTVVDSR

SEQ ID NO: 6225 - protein, 218 aa, Setaria italica
MVLWVFGYGSLIWNPGFDFDDKILGFIKGYKRTFNLACIDHRGTPEHPARTCTLETDEEAICWGIAYCVKGDTDKEQKAMQYLERRECEYDQKISVDFFKEGDSLKPAVTGVLVFVSTPDPIGNKYYLGPAPLQDMARQIATANGPTGYNRDYLFSMEKALASIIHEDDSIIELANEVRKVLNRTKEAKITGSDVSLQSHVPLVHLSALPEGTVVDSR

SEQ ID NO: 6226 - protein, 217 aa, Cenchrus ciliaris
  misc_feature (104)..(104): Xaa can be any naturally occurring amino acid
MVLWVFGYGSLIWNPGFDFDDKILGFIKGYKRTFNLACIDHRGTPEHPARTCTLETEEEAICWGIAYCVKGGTDKERVAMQYLERRECEYDQKISVDFFKEGDXLKPAVTGVLVFVSTPDPIGNKYYLGPAPLQDMARQIATATGPTGYNRDYLFSMEKALASISHEDDSIIELANEVRKVLNRTETKIIGSDVSLQSHVPLVHLSVLPEGTVVDSR

SEQ ID NO: 6227 - protein, 218 aa, Panicum virgatum
MVLWVFGYGSLIWNPGFDFDDKILGFIKGYKRTFNLACIDHRGTLEHPARTCTLETDEEAICWGIAYCVKGGIDKERKAMQYLERRECEYDQKISVDFFKEGDSLKPAVTNVLVFVSTPDPIGNKYYLGPAPLKDMARQIATANGPNGYNRDYLFSMEKALASISHEDDAIIELANEVRMVLNRAKEAKITGSDRTLKSHVPLVHLSALPEGTVVDSR

SEQ ID NO: 6228 - protein, 220 aa, Pennisetum glaucum
MVLWVFGYGSLIWNPGFDFDAKILGFIKGYKRTFNLACIDHRGTPEHPARTCTLETEEEAICWGIAYCVKGGTDKERKAMQYLERRECEYDQKISVDFFKCQEGDSLKPAVTGVLVFVSTPDPIGNKYYLGPAPLQDMARQIATANGPTGHNRDYLFSMEKALASISHQDDSIIELANEVRKVLNRTKETKITGSDVSLPSHVPLVHPSALSEGTVVDAR

SEQ ID NO: 6229 - protein, 218 aa, Panicum virgatum
MVLWVFGYGSLIWNPGFDFDDKILGFIKGYKRTFNLACIDHRGTPEHPARTCTLETDEEAICWGIAYCVKGGIDKERKAMQYLERRECEYDQKISVDFFKEGDSLKPAVTNVLVFVSTPDPIGNKYYLGPAPLEDMARQIATANGPNGYNRDYLFNMEKALASISHEDDAIIELANEVRMVLNRAKEAKVTGSDITLKSHVQLVHLSALPEGTVVDSR

SEQ ID NO: 6230 - protein, 216 aa, Oryza sativa
MVLWVFGYGSLIWNPGFDFDEKILGFVKGYKRTFNLACIDHRGTPEHPARTCTLESDEEAICWGIAYCVKGGLKKEQEAMKYLERRECEYDQKISVDFYKEGDSLKPAVTGVLVFVSTPDPVGNKYYLGPAPLEDMARQIATANGPNGNNRDYLFSMEKALSNICHEDDSIIELANEVRKVLSRPKEKITGSDSPQKSHALVHLSALPEGTVVDSR

SEQ ID NO: 6231 - protein, 181 aa, Euonymus alatus
MVLWVFGYGSLIWNPGFDFDEKILGFIKGHKRTFNLACIDHRGTPKNAARTYTLESEDEAICWGIAYCVKGGLEKEREAMQYLERRECEYDQKISVDFYKDGDSLKPAVTGGLVFVSTPDPVGNKYYLGPAPLEDMARQIATANGPNGNNRDYLFSMEKALSNISHEDDSIIELANEVRKS

SEQ ID NO: 6232 - protein, 218 aa, Leymus cinereus x Leymus triticoides
MVLWVFGYGSLIWNPGFDFDEKILGFIKGYKRTFNLACIDHRGTPQNPARTCTLESEDEAICWGIAYCVKGGLEKEREAMQYLERRECEYDQKISVDFYKDGNSLEPAVTDVLVFVSTPDPVGNKYYLGPAALEDMARQIATASGPNGYNRDYLFSMEKALSNISHEDDSIIELADEVRKVLSRSTEKKVTGSDIPLKSHTPVVHISALPEGTVVVST

SEQ ID NO: 6233 - protein, 218 aa, Secale cereale
MVLWVFGYGSLIWNPGFDFDDKILGFIKGYKRTFNLACIDHRGTPQHPARTCTLESQDEAICWGIAYCVKGGLEKEREAMQYLERRECEYDQKISVDFYKDGNSLEPAVTDVLVFVSTPDPVGNKYYLGPAALEDMARQIATASGPNGYNRDYLFSMEKALSNISHEDDTIIELADEVRKVLSRSTEKKVTGSDMPLKSHTPVVHISALPEGTVAVST

SEQ ID NO: 6234 - protein, 218 aa, Hordeum vulgare
MVLWVFGYGSLIWNPGFDFDDKILGFIKGYKRTFNLACIDHRGTPQHPARTCTLESEDEAICWGIAYCVKGGLEKEREAMQYLERRECEYDQKISVDFYKDGNSLEPAVTDVLVFVSTPDPVGNKYYLGPAALEDMARQIATASGPNGYNRDYLFSMEKALSNISHEDDSIIVLADEVRKVLGRSTEKKVTGSDVPLKSHTPAVHISALPEGTVAVST

SEQ ID NO: 6235 - protein, 217 aa, Pseudoroegneria spicata
MVLWVFGYGSLIWNPGFDFDEKILGFIKGYKRTFNLACIDHRGTPQNPARTCTLESEDEAICWGIAYCVKGGLEKEREAMQYLERRECEYDQKISVDFYKDGNYLEPAVTDVLVFVSTPDPVGNKYYLGPAALEDMARQIATASGPNGYNRDYLFSMEKALSNISHEDDSIIVLADEVRKVLNRSTEKKVTGSDIPLKSHTPVVHISALPEGTVVST

SEQ ID NO: 6236 - protein, 218 aa, Triticum aestivum
MVLWVFGYGSLIWNPGFDFDEKILGFIKGYKRTFNLACIDHRGTPQHPARTCTLESEDEAICWGIAYCVKGGLEKEREAMQYLERRECEYDQKISVDFYKDGNSLEPAVTDVLVFVSTPDPVGNKYYLGPAALEDMARQIATASGPNGYNRDYLFSMEKALSNISHEDDSIIVLADEVRKVLSRSTEKKVTGSDIPLKSHTPVVHISALPEGTVAVST

SEQ ID NO: 6237 - protein, 219 aa, Festuca arundinacea
MVLWVFGYGSLIWNPGFDFDEKILGFITGYKRTFNLACIDHRGTPKDPARTCTLESEEGAICWGIAYCVNGGPEKEREAMQYLERRECEYDQKISVDFYKDGNSLEPSVTGVLVFVSTPDPVGNKYYLGPAPLEDMAMQIATASGPTGNNRDYLFSMEKALSNISHEDDSIIELADEVRKVLSRSNEKKITGPDIPLKSQTPLVHLSPLLEGTVVDSRY

SEQ ID NO: 6238 - protein, 218 aa, Triticum aestivum
MVLWVFGYGSLIWNPGFDFDEKILGFIKGYKRTFNLACIDHRGTPQHPARTCTLESEDEAICWGIAYCVKGGLEKEREAMQYLERRECEYDQKISVDFYKDGNSLEPAVTDVLVFVSTPDPVGNKYYLGPAALEDMARQIATASGPNGYNRDYLFSMEKALSNISHEDESIIVLADEVRKVLSRSTEKKVTGSDMPLKSHTPVVHIPALPEGTVVVST

SEQ ID NO: 6239 - protein, 218 aa, Triticum aestivum
MVLWVFGYGSLIWNPGFDFDDKILGFIKGYKRTFNLACIDHRGTPQHPARTCTLESEDGAICWGIAYCVKGGLEKEREAMQYLERRECEYDQKISVDFYKDGNSLEPAVTDVLVFVSTPDPVGNKYYLGPAALEDMARQIATASGPNGYNRDYLFSMEKALSNISHEDDTIIELADEVRKVLSRSTEKKVTGSDMPLKSHTPVLHIPALPEGTVVVST

SEQ ID NO: 6240 - protein, 218 aa, Triticum aestivum
MVLWVFGYGSLIWKPGFDFDEKILGFIKGYKRTFNLACIDHRGTPQHPARTCTLESEDEAICWGIAYCVKGGLEKEREAMQYLERRECEYDQKISVDFYRDGNSLEPAVTDVLVFVSTPDPVGNKYYLGPAALEDMAKQIATASGPNGYNRDYLFSMEKALSNISHEDDSIIVLADEVRKVLSRSTEKKVTGSDIPLKSHTPVVHISALPEGTVAVST

SEQ ID NO: 6241 - protein, 218 aa, Avena sativa
MVLWVFGYGSLIWNPGFDFDQKMLGFIKGYKRTFNLACIDHRGTPKDPARTCTLESEEEAICWGIAYCVNGGLEKEQEAMRYLEKRECEYDQKISVDFYEDANSLEPSVTGVLVFVSTPDPVGNKYYLGPAPLEDMARQIATANGPTGNNRDYLFSMEKALSNISHEDDSIIELADAVRKVLSRSNEKKITGSDIPLKSHTPLVYLSPLLEGTVMDSR

SEQ ID NO: 6242 - protein, 339 aa, Sorghum bicolor
MLVRSASTPVLGALLPSGSHSPAVSSPAVHFPESPAAAAYHPPPISCHLAGPGSGSDHERTRGLGTGIRRTCSEDNLASLAGVRADDHHHHHLPPSGKGAPRARPVPLETIQSFRGRQASSTDDEEEDEEEDAYEVERELRFGQFSFAGGDGNGSTYSQEHPLFLARGLGIDRLGSGLLSADGGGGFGGSDGGGGGNLVASGNGGDRSGIEMHYKKMIEEDPCNGLFLRNYAQFLYQVKGDYRRAEEYYSRAILADPDDGELLSEYAKLVWDVHRDEERASSYFERAAKASPQNSHVLAAHAAFLWDTDDDEEGGGDVLSCYTGFAQPAHSSPLASATT

SEQ ID NO: 6243 - protein, 336 aa, Saccharum officinarum
MLVRSASTPVLGALLPSGSHSPAVSSPAVHFHESPAVAYHPPTISCHLAGPGSGSDHERSRVGMRRTCSEDNLASLAGVRADDHQHHHLPPSGKGAPRARPVPLETIQSFRGRQASTDDEEEEEAYEVERELRFGQFSFAGSTYSQEHPLFLARGLGIDRLGSGLLSADVGGGGFGGSDGGAGFGGSDGGGGSNLVASGNGGDRSGIEMHYKKMIEEDPCNGLFLRNYAQFLYQVKGDYRRAEEYYSRAILADPDDGELLSEYAKLVWDVHRDEERASSYFERAAKASPQNSHVLAAHAAFLWDTDDDEEGGGDVLSSYAGFAQPAHSSTLASATT

SEQ ID NO: 6244 - protein, 264 aa, Saccharum officinarum
MMAAARMALASCARLLPSSPSPLTLARPRAGAVSFLAARPSPRSGRNLALLCSLTPTSLSLTEVSVAPPPPQDAVDETKHPVPGGDEKAEPTVEELVGLLDVRVGRVVKAWRHPEADTLYVEEVDVSEAEPRTICSGLVNFLPIEELQDSNVIVLANLKPRNMRGIKSNGMLMAASDASHENVELLIPPEGSFPGERVWFGSEEEMHRRSDPASPNQVQKKKIWEAVQPHLRTTDNCIVVLGDKQMRTSAGLIFCKSLQGARVS

SEQ ID NO: 6245 - protein, 254 aa, Sorghum bicolor
MMAAARMAFASCARLLPSSSSPLTLARPRAGAVSFLAARPSPRSGRNLALFCSSSPTSLPLTDAVEETKPPVPSGDDKAEPTVEDLVGLLDVRVGRVLKAWRHPEADTLYVEEVDVGEAEPRTICSGLVNFIPIQDLQDSNVIVLANLKPRNMRGIKSNGMLMAASDASHENVELLIPPEGSLPGERVWFGSEEEKHRQSDPASPNQVQKKKIWEAVQPHLRTTDNCIVVLGDKQMRTSAGPIFCKSLQGARVS

SEQ ID NO: 6246 - protein, 266 aa, Setaria italica
MLAAARMAFASCARLLPSSPSTLTSVRARAGAVSFLVPPPAPSAAARSSRNLALCCSSSSPPPADAAVAPPPTQTAAEEAKPAAPGGDEKAEPTVEELAGLLDIRVGRVVKAWRHPEADTLYVEEVDVGEAEPRTICSGLVNFLPIEELQDSSVIVLANLKPRNMRGIKSNGMLMAASDASHENVELLTPPEGSVPGERVWFGSEEEKDRQSEPASPNQIQKKKIWESVQPHLKTTDNCVAVLGEHPMRTSAGSVFCKSLQGARVS

SEQ ID NO: 6247 - protein, 99 aa, Sorghum bicolor
MASGGPALEPLVDQVISVITNDGRNIVGTLRGFDQATNIILDESHERVYSRKEGVQQLVLGLYIIRGDNISVVGEVDEDLDSRLDMSKLRAHPLKPVIH

SEQ ID NO: 6248 - protein, 99 aa, Panicum virgatum
MASGGPALESLVDQVISVITNDGRNIVGTLRGFDQATNIILDESHERVYSTKEGVQQLVLGLYIIRGDNISVVGEVDEDLDARLDLSKLRAHPLKPVIH

SEQ ID NO: 6249 - protein, 99 aa, Setaria italica
MASGGPALESLVNQVISVITNDGRNIVGTLRGFDQATNIILDESHERVYSTKEGVQQLVLGLYIIRGDNISVVGEVDEDLDARLDLSKLRAHPLKPVIH

SEQ ID NO: 6250 - protein, 99 aa, Cynodon dactylon
MASGGPALESLVDQVISVITNDGRNIVGTLRGFDQATNVILDESHERVYSTKEGVQQLVLGLYIIRGDNISVVGEVDEDLDARLDLSQLRAHPLKPVIH

SEQ ID NO: 6251 - protein, 99 aa, Avena sativa
MASVGPTLESLVDQVISVITNDGRNIVGTLRGFDQATNIILDESHERVYSTKEGVQQLVLGLYIIRGDNISVVGEVDEELDAALDMSKLRAQPLKPVIH

SEQ ID NO: 6252 - protein, 99 aa, Unknown
  Sequence found in Organisms: Leymus cinereus x Leymus triticoides, Secale cereale, Triticum aestivum
MASVGPTLESLVDQVISVITNDGRNIVGTLRGFDQATNIILDESHERVYSTKEGVQQLVLGLYIIRGDNIGVVGEVDEELDAALDMSKLRAQPLKPVIH

SEQ ID NO: 6253 - protein, 99 aa, Brachypodium distachyon
MASAGPTLESLVDQVISVITNDGRNIVGTLRGFDQATNIILDESHERVYSTKEGVQQLVLGLYIIRGDNIGVVGEVDEELDAALDMSKLRAQPLKPVIH

SEQ ID NO: 6254 - protein, 99 aa, Pennisetum glaucum
MATGGPALESLVNQIISVITNDGRNIVGTLRGFDQATNIILDESHERVYSTKEGVQQLVLGLYIIRGDNISVVGEVDEDLDARLDLSKLRAHPLKPVIH

SEQ ID NO: 6255 - protein, 99 aa, Oryza sativa
MASAGPGLESLVDQIISVITNDGRNIVGTLRGFDQATNIILDESHERVYSTREGVQQLVLGLYIIRGDNISVVGEVDEELDARLDLSNLRAHPLKPVIH

SEQ ID NO: 6256 - protein, 98 aa, Unknown
  Sequence found in Organisms: Cucurbita pepo, Platanus occidentalis, Citrullus lanatus
MASGPGLESLVDQTISVITNDGRNIVGVLKGFDQATNIILDESHERVYSTKEGVQQLVLGLYIIRGDNISIVGELDEELDSNLDLSKLRAHPLKPVIH

SEQ ID NO: 6257 - protein, 98 aa, Papaver somniferum
MSGGPGLESLVDQQISVITNDGRNIVGVLKGFDQATNIILDESHERVYSTKEGVQQLVLGLYIIRGDNISIVGEVDEELDSNLDMSKLRAHPLKPIIH

SEQ ID NO: 6258 - protein, 99 aa, Trigonella foenum-graecum
MATGGPGLESLVDQQISVITNDGRNIVGVLKGFDQATNIILDESHERVFSTKEGVQQLVLGLYIIRGDNISVVGELDEELDSSLDLSKLRAHPLKPVIH

SEQ ID NO: 6259 - protein, 98 aa, Nicotiana tabacum
MASGPGLESLVDQTISVITNDGRNIVGVLRGFDQATNLILDESHERVYSTKEGVQQLVLGLYIIRGDNISVVGELDEELDANLDMSKLRAHPLKPVVH

SEQ ID NO: 6260 - protein, 98 aa, Musa acuminata
MSTGPGLETLVDQTISVITNDGRNIVGVLRGFDQATNIILDESHERVYSTKEGVQQLVLGLYIIRGDNISVVGELDEELDANLDLSKLRAHPLKPVIH

SEQ ID NO: 6261 - protein, 98 aa, Citrus clementina
MSGGPGLESLVDQQISVITNDGRNIVGVLKGFDQATNIILDESHERVYSTKEGVQQLVLGLYIIRGDNISIVGEVDEELDSHLDLSNLRAHPLKPVIH

SEQ ID NO: 6262 - protein, 98 aa, Unknown
  Sequence found in Organisms: Solanum lycopersicum, Coffea canephora
MASGLGLESLVDQTISVITNDGRNIVGVLRGFDQATNLILDESHERVYSTKEGVQQLVLGLYIIRGDNISVVGELDEDLDSNLDMSKLRAHPLKPVVH

SEQ ID NO: 6263 - protein, 98 aa, Unknown
  Sequence found in Organisms: Cucumis sativus, Cucumis melo
MASGPGLDSLVDQTISVITNDGRNIVGVLKGFDQATNIILDESHERVYSTKEGVQQLVLGLYIIRGDNISIVGELDEELDSNLDLSKLRAHPLKPVIH

SEQ ID NO: 6264 - protein, 98 aa, Glycine max
MSAGPGLESLVDQTISVITNDGRNIVGVLKGFDQATNIILDESHERVYSTKEGVQQLVLGLYIIRGDNISVVGELDEELDSSLDLSKLRAHPLKPVIH

SEQ ID NO: 6265 - protein, 98 aa, Amsonia hubrichtii
MATGPGLESLVDQTISVITNDGRNIVGILKGFDQATNIILDESHERVYSTKEGVQQLVLGLYIIRGDNISIVGELDEELDANLDLSKLRAHPLKPVIH

SEQ ID NO: 6266 - protein, 98 aa, Unknown
  Sequence found in Organisms: Gossypium hirsutum, Gossypium raimondii, Heritiera littoralis
MSTGPGLESLVDQTISVITNDGRNIVGVLKGFDQATNIILDESHERVYSTKEGVQQLVLGLYIIRGDNISVVGELDEELDSALDLSNLRAHPLKPVIH

SEQ ID NO: 6267 - protein, 98 aa, Linum usitatissimum
MASGLGLESLVDQTISVITNDGRNIVGNLKGFDQATNIILDESHERVYSTKEGVQQLVLGLYIIRGDNISVIGELDEELDAQLDMSNLRAHPLKPVIH

SEQ ID NO: 6268 - protein, 98 aa, Linum usitatissimum
MASGLGLESLVDQTISVITNDGRNIVGNLKGFDQATNIILDESHERVYSTKEGVQQLVLGLYIIRGDNISVIGELDEELDAHLDMSNLRAHPLKPVIH

SEQ ID NO: 6269 - protein, 98 aa, Phalaenopsis aphrodite
MSTGPGLESLVDQTISVITNDGRNIVGILKGFDQATNIILDESHERVYSTKEGVQQLVLGLYIIRGDNISVVGELDEELDANLDLSKLRAHPLKPVIH

SEQ ID NO: 6270 - protein, 98 aa, Amborella trichopoda
MSSGPGLESLVDQTISVITNDGRNIVGILKGFDQATNIILDESHERVYSTKEGVQQLVLGLYIIRGDNISVIGELDEELDSNLDLSKLRAHPLKPVIH

SEQ ID NO: 6271 - protein, 95 aa, Hordeum vulgare
MATLESLVDQVISVITNDGRNIVGTLRGFDQATNIILDESHERVYSTKEGVQQLVLGLYIIRGDNIGVVGEVDEELDAALDMSKLRAQPLKPVIH

SEQ ID NO: 6272 - protein, 98 aa, Unknown
  Sequence found in Organisms: Phaseolus coccineus, Cajanus cajan
MSAGPGLESLVDQTISVITNDGRNIVGVLKGFDQATNIILDESHERVYSTKEGVQQLVLGLYIIRGDNISVVGELDEDLDSSLDLSKLRAHPLKPVIH

SEQ ID NO: 6273 - protein, 98 aa, Theobroma cacao
MSTGPGLESLVDQTISVITNDGRNIVGILKGFDQATNIILDESHERVYSTKEGVQQLVLGLYIIRGDNISVVGELDEELDSALDLSNLRAHPLKPVIH

SEQ ID NO: 6274 - protein, 98 aa, Unknown
  Sequence found in Organisms: Citrus sinensis, Citrus sinensis
MSGGPGLESLVEQQISVITNDGRNIVGVLKGFDQATNIILDESHERVYSTKEGVQQLVLGLYIIRGDNISIVGEVDEELDSHLDLSNLRAHPLKPVIH

SEQ ID NO: 6275 - protein, 98 aa, Coffea canephora
MSGGPGLESLVDQTISVITNDGRNIVGILKGFDQATNIILDESHERVYSTKEGVQQLVLGLYIIRGDNISIVGELDEELDANLDLSKLRAHPLKPVIH

SEQ ID NO: 6276 - protein, 98 aa, Vigna unguiculata
MSAGPGLESLVDQTISVITNDGRNIVGVLKGFDQATNIILDESHERVYSTKEGVQQLVLGLYIIRGDNISVVGELDEDLDSNLDLSKLRAHPLKPVIH

SEQ ID NO: 6277 - protein, 98 aa, Quercus alba
MSGGPGLESLVDQTISVITNDGRNIVGVLKGFDQATNIILDESHERVYSTKEGVQQLVLGLYIIRGDNISVVGELDEELDAHLDLSKLRAQPLKPVIH

SEQ ID NO: 6278 - protein, 98 aa, Solanum phureja
MATGLGLESLVDQTISVITNDGRNIVGVLRGFDQATNLILDESHERVYSTKEGVQQLVLGLYIIRGDNISVVGELDEDLDSNLDMSKLRAHPLKPVVH

SEQ ID NO: 6279 - protein, 98 aa, Fagus grandifolia
MSSGPGLESLVDQTISIITNDGRNIVGVLKGFDQATNIILDESHERVYSTKEGVQQLVLGLYIIRGDNISIVGELDEELDSHLDLSKLRAHPLKPVIH

SEQ ID NO: 6280 - protein, 98 aa, Bupleurum chinense
MSGGAGLENLVDQIISVITNDGRNILGILKGFDQATNIILDESHERVYSTKEGVQQLVLGLYIIRGDNISIVGEVDEELDASLDLSKLRAHPLKPVIH

SEQ ID NO: 6281 - protein, 98 aa, Bupleurum chinense
MSGGAGLENLVDQIISVITNDGRNILGILKGFDQATNIILDESHERVYSTKEGVQQLVLGLYIIRGDNISIVGEVDEELDANLDLSKLRAHPLKPVIH

SEQ ID NO: 6282 - protein, 98 aa, Cicer arietinum
MSTGPGLESLVDQTISVITNDGRNIVGVLKGFDQATNIILDESHERVFSTKEGVQQLVLGLYIIRGDNISVVGELDEELDSNLDLSKLRAHPLKAVIH

SEQ ID NO: 6283 - protein, 98 aa, Eucalyptus grandis
MSTGPGLDSLVDQTISVITNDGRNIVGVLKGYDQATNIILDESHERVYSTKEGVQQLVLGLYIIRGDNISVVGELDEELDSNLDLSKLRAHPLKPVIH

SEQ ID NO: 6284 - protein, 98 aa, Fagopyrum esculentum
MATGPGLESLVDQQISVITNDGRNIVGVLKGFDQATNIILDESHERVYSTKEGVQQLVLGLYIIRGDNISVIGELDEDLDANLDLSKLRAHPLKPVIH

SEQ ID NO: 6285 - protein, 99 aa, Medicago truncatula
MATGGPGLESLVDQHISVITHDGRNIVGVLKGFDQATNIILDESHERVFSTREGVQQLVLGLYIIRGDNISVVGELDEELDSSLDLSQLRAHPLKPVIH

SEQ ID NO: 6286 - protein, 98 aa, Sarracenia psittacina
MSSGPGLESLVDQTISVITNDGRNIVGVLKGFDQATNIILDESHERVYSTKEGVQQLVLGLYIIRGDNISIVGELDEELDANLDLSKLRAHPLKPVIH

SEQ ID NO: 6287 - protein, 98 aa, Utricularia gibba
MASGIGLESLVDQTISVITNDGRNIVGVLKGFDQATNIILDESHERVYSTKEGVQQLVLGLYIIRGDNISVVGEIDEEIDADLDLSKVRAHPLKPVIH

SEQ ID NO: 6288 - protein, 98 aa, Antirrhinum majus
MASGMGLESLVDQTISIITNDGRNIVGVLRGFDQATNIILDESHERVYSTKEGVQQLVLGLYIIRGDNISIVGELDEELDEKLDLSELRAHPLKPVIH

SEQ ID NO: 6289 - protein, 98 aa, Aquilegia formosa
MSGGPGLESLVDQQISVITNDGRNIVGVLKGFDQATNIILDESHERVYSTKEGVQQLVLGLYIIRGDNISIVGEVDEDLDSNLDLSELRAHPLKPIIH

SEQ ID NO: 6290 - protein, 98 aa, Manihot esculenta
MSTGPGLESLVDQTISVITNDGRNIVGILKGFDQATNIILDESHERVYSTKEGVQQLVLGLYIIRGDNISIVGELDEELDSHLDLSNLRAHPLKPVIH

SEQ ID NO: 6291 - protein, 98 aa, Solanum melongena
MSTGLGLESLVDQTISVITNDGRNIVGVLRGFDQATNLILDESHERVYSTKEGVQQLVLGLYIIRGDNISVVGELDEDLDSNLDMSKLRAHPLKPVVH

SEQ ID NO: 6292 - protein, 98 aa, Vitis vinifera
MSTGPGLESLVDQTISVITNDGRNIVGVLKGFDQATNIILDESHERVYSTKEGVQQLVLGLYIIRGDNISIVGELDEELDSSLDLSKLRAHPLKPVTH

SEQ ID NO: 6293 - protein, 98 aa, Ipomoea nil
MSGGPGLESLVDQTISVITNDGRNIVGILKGFDQATNLILDESHERVYSTKEGVQQLVLGLYIIRGDNISVVGELDEELDANLDLSKLRAHPLKPVVH

SEQ ID NO: 6294 - protein, 99 aa, Jatropha curcas
MSSTGPGLESLVDQTISVITNDGRNIVGILKGFDQATNIILDESHERVYSTKEGVQQLVLGLYIIRGDNISIVGELDEELDSHLDLSNVRAHPLKPVIH

SEQ ID NO: 6295 - protein, 98 aa, Ananas comosus
MSDGPGLESLVDQTISVITNDGRNIVGILKGFDQATNIILDESHERVYSTKEGVQQLVLGLYIIRGDNISVVGELDEELDANLDLSKLRAHPFKPVIH

SEQ ID NO: 6296 - protein, 98 aa, Salvia sclarea
MATGAGLETLVDQTISVITNDGRNIVGILKGFDQATNIILDESHERVYSTKEGVQQLVLGLYIIRGDNISIVGELDEELDASLDLSKLRAHPLKPVIH

SEQ ID NO: 6297 - protein, 98 aa, Amorphophallus konjac
MSTGPGLESLVDQTISVITNDGRNIVGILKGFDQATNIILDESHERVYSTKEGVQQLVLGLYIIRGDNISVIGELDEELDANLDLSKLRAQPLKPVIH

SEQ ID NO: 6298 - protein, 98 aa, Catharanthus roseus
MSTGPGLESLVDQNISVITNDGRNIVGILKGFDQATNLILDESHERVYSTKEGVQQLVLGLYIIRGDNISIVGELDEELDASLDLSKLRAHPLKPVIH

SEQ ID NO: 6299 - protein, 98 aa, Eucalyptus grandis
MSTGPGLDSLVDQTISVITNDGRNIVGVLKGYDQATNIILDESHERVYSTKEGVQQLVLGLYIIRGDNISVVGELDEELDSNLDFSKLRAHPFKPVIH

SEQ ID NO: 6300 - protein, 97 aa, Euonymus alatus
MSGPGLESLVDQTISVITNDGRNIVGILKGFDQATNIILDESHERVYSTKEGVQLLVLGLYIIRGDNISIVGELDEELDSRLDLSSLRAHPLKPVIH

SEQ ID NO: 6301 - protein, 97 aa, Tropaeolum majus
MSGPGLESLVDQTISVITNDGRNIVGILKGFDQATNIILDESHERVYSTKEGVQQLVLGLYIIRGDNISIVGELDEELDSALDLSNLRAHPLKPVIH

SEQ ID NO: 6302 - protein, 98 aa, Tabernaemontana elegans
MSTGPGLESLVDQTISVITNDGRNIVGILKGFDQATNIILDESHERVYSTKEGVQQLVLGLYIIRGDNISIVGELDEELDANLDLSKLRAQPLKPVIH

SEQ ID NO: 6303 - protein, 98 aa, Acacia harpophylla
MSTGPGLETLVDQTISVITNDGRNIVGILKGFDQATNIILDESHERVCSTKEGVQQLVLGLYIIRGDNISVVGELDEDLDSSLDLSKLRAHPLRPVIH

SEQ ID NO: 6304 - protein, 98 aa, Manihot esculenta
MSTGPGLESLVDQTISVITNDGRNIVGILKGFDQATNIILDESHERVYSTKEGVQQLVLGLYIIRGDNISIVGELDEELDSHLDLLNLRAHPLKPVIH

SEQ ID NO: 6305 - protein, 98 aa, Arachis hypogaea
MSDGPGLESLVDQTISVITNDGRNIVGILKGFDQATNIILDESHERVYSTKEGVQQLVLGLYIIRGDNISVVGELDEDLDSNLDLKNLRAHPLKPVIH

SEQ ID NO: 6306 - protein, 64 aa, Cicer arietinum
MSTGPGLESFVDQTISVITNDGRNIVGVLKGFDQATNIILDESHERVFFYQGRCSATCFRFIHH

SEQ ID NO: 6307 - protein, 72 aa, Tropaeolum majus
TAGGSICPLYTALCSPSPRVSAKKLGFEVSIHKFTQKSSRNQEHIVHLTLRDCKMSGPGLESLVDQTISYHK

SEQ ID NO: 6308 - protein, 98 aa, Unknown
  Sequence found in Organisms: Centaurea maculosa, Cirsium arvense
MLGGPGLESVVDQIISVITNDGRNIVGVLKGFDQATNIILDESHERVYSTKEGVQQLVLGLYIIRGDNISVIGELDEELDASLDLSELRAHPLKPVIH

SEQ ID NO: 6309 - protein, 98 aa, Cirsium arvense
MLGGPGLESVVDQIISVITNDGRNIVGILKGFDQATNIILDESHERVYSTKEGVQQLVLGLYIIRGDNISVIGELDEELDAGLDLSELRAHPLKPVIH

SEQ ID NO: 6310 - protein, 97 aa, Euonymus alatus
MSGPGLESLVDQTISVITNDGRNIVGILKGFDQATNIILDESHERVYSTKEGVQLLVLGLYIIRGDNISIVGELDEELDSSLDLSSLRAHPLKPVIH

SEQ ID NO: 6311 - protein, 98 aa, Elaeis guineensis
MSSGPGLQSLVDQTISVITNDGRHIVGILKGFDQATNIILDESHERVYSTKEGVQQLVLGLYIIRGDNISIVGELDEELDANLDLSKLRAHPLKPVIH

SEQ ID NO: 6312 - protein, 98 aa, Plantago ovata
MATGAGLESLVDQTISIITNDGRNIVGVLKGFDQATNIILDESHERVYSTKEGVQQLVLGLYIIRGDNISIVGEIDEERDEQLDLSKLRAHPLKPVIH

SEQ ID NO: 6313 - protein, 97 aa, Tripterygium wilfordii
MSGPGLESLVDQTISVITNDGRNIVGILKGFDQATNIILDESHERVYSTKEGVQLLVLGLYIIRGDNISIVGELDEELDSHLDLSSLRAHPLKPVIH

SEQ ID NO: 6314 - protein, 98 aa, Vinca minor
MSTGLGLESLVDQTISVITNDGRNIVGILKGFDQATNIILDESHERVYSTKEGVQQLVLGLYIIRGDNIGIVGELDEELDANLDLSKLRAHPLKPVIH

SEQ ID NO: 6315 - protein, 98 aa, Persea americana
MSSSIGLESLVDQTISVITNDGRNIVGVLKGFDQATNIILDESHERVYSTKEGVQQLVLGLYIIRGDNISVVGELDEELDSNLNLSELRAHPLKPVIH

SEQ ID NO: 6316 - protein, 98 aa, Centaurea maculosa
MLGGPGLETVVDQIISVITNDGRNIVGVLKGFDQATNIILDESHERVYSTKEGVQQLVLGLYIIRGDNISVIGELDEELDAGLDLSELRAHPLKPVIH

SEQ ID NO: 6317 - protein, 98 aa, Cichorium intybus
MLGGPGLETVVDQIISVITNDGRNIVGVLKGFDQATNIILDESHERVYSTKEGVQQLVLGLYIIRGDNISVIGELDEELDASLDLSELRAHPLKPVIH

SEQ ID NO: 6318 - protein, 98 aa, Cynara scolymus
MLGGPGLESVVDQIISVITNDGRNIVGVLKGFDQATNIILDESHERVYSTKEGVQQLVLGLYIIRGDNISVIGELDEELDAGLDLSELRAHPLKPVIH

SEQ ID NO: 6319 - protein, 98 aa, Hevea brasiliensis
MSTGLGLESLVDQTISVITNDGRNIVGILKGFDQATNIILDESHERVYSTKEGVQQLVLGLYIIRGDNISIVGELDEELDSHIDLSNLRAHPLKPVIH

SEQ ID NO: 6320 - protein, 98 aa, Mimulus guttatus
MATDAGLENLVDQIISVITNDGRNIVGVLKGFDQATNIILDESHERVYSTKEGVQQLVLGLYIIRGDNISIVGELDEELDASLDLSALRAHPLKPVIH

SEQ ID NO: 6321 - protein, 98 aa, Triphysaria pusilla
MATGTGLETLVDQMISIITNDGRNIVGVLKGFDQATNIILDESHERVYSTKEGVQQLVLGLYIIRGDNISIVGELDEELDASLDLSNLRAHPLKPVIH

SEQ ID NO: 6322 - protein, 98 aa, Unknown
  Sequence found in Organisms: Cannabis sativa, Humulus lupulus
MSGGPGLESLVDQTISVITNDGRNIVGVLKGFDQATNIILDESHERVFSTKEGVQQLVLGLYIIRGDNISIVGELDEEIDSSVDWSEKRAHPLKPVIH

SEQ ID NO: 6323 - protein, 98 aa, Cirsium arvense
MLGGPGLESVVDQIISVITNDGRNIVGILKGFDQATNIILDESHERVYSTKEGVQQLVLGLYIIRGDNISIIGELDEELDASLDLSELRAHPLKPVIH

SEQ ID NO: 6324 - protein, 98 aa, Unknown
  Sequence found in Organisms: Flaveria ramosissima, Helianthus annuus
MLGGPGLESVVDQYISVITNDGRNIVGVLKGFDQATNIILDESHERVYSTKEGVQQLVLGLYIIRGDNISVIGELDEELDASLNLSELRAHPLKPVIH

SEQ ID NO: 6325 - protein, 98 aa, Olea europaea
MSSGLGLENLVDQTISVITNDGRNIVGILKGFDQATNIILDESHERVYSTEEGVQQLVLGLYIIRGDNISIVGEIDEELDASLDLSLLRAHPLKPVIH

SEQ ID NO: 6326 - protein, 98 aa, Unknown
  Sequence found in Organisms: Rosa hybrid cultivar, Fragaria vesca
MSGGPGLESLVDQTISVITNDGRNIVGVLKGFDQATNIILDESHERVFSTKEGVQQLVLGLYIIRGDNISIVGELDADLDSSLDWSKMRAYPLKPVIH

SEQ ID NO: 6327 - protein, 98 aa, Aristolochia fimbriata
MSTGPGLESLVDQQISVITNDGRNIVGILKGYDQATNIILDESHERVYSTKQGVQQLVLGLYIIRGDNISVVGELDEELEASLDLSKLRAQPLKPVIH

SEQ ID NO: 6328 - protein, 98 aa, Artemisia annua
MLGGPGLESVVDQIISVITNDGRNIVGLLKGFDQATNIILDESHERVYSTKEGVQQLVLGLYIIRGDNISVIGELDEELDASLNMSELRAHPLKPIIH

SEQ ID NO: 6329 - protein, 98 aa, Cynara scolymus
MLGGPGLESVVDQIISVITNDGRNIVGVLKGFDQATNIILDESHERVYSTKEGVQQLVLGLYIIRGDNISIIGELDEELDASLDLSELRAHPLKPVIH

SEQ ID NO: 6330 - protein, 98 aa, Taraxacum officinale
MLGGPGLETVVDQIISVITNDGRNIVGVLKGFDQATNIILDESHERVYSTKEGVQQLVLGLYIIRGDNISVIGELDEELDASLDLSQLKAHPLKPVIH

SEQ ID NO: 6331 - protein, 98 aa, Lotus japonicus
MSTGPGLESLVDQQISVITNDGRNIVGVLKGFDQATNIILDESHERVFSTKEGVQQIVLGLYIIRGDNISVVGELDLDLDRSLDMTKLRAHPLKPVIH

SEQ ID NO: 6332 - protein, 98 aa, Populus trichocarpa
MSIGTGLESLVDQTISIITNDGRNIVGVLKGFDQATNIILDESHERVYSTKEGVQQLVLGLYIIRGDNIGVVGELDEELDAHLDLSSLRAHPLKPVIH

SEQ ID NO: 6333 - protein, 98 aa, Zinnia violacea
MLGGPGLESVVDQYISVITNDGRNIVGVLKGFDQATNIILDESHERVYSTKEGVQQLVLGLYIIRGDNISVIGELDEELDATLNLSELRAHPLKPVIH

SEQ ID NO: 6334 - protein, 95 aa, Momordica charantia
PGLESLVDQTISVITNDGRNIVGVLKGFDQATNIILDESHERVYSTKEGVQQLVLGLYIIRGDNISIVGELDEELDSNLDLSKLRAHPLKPVYSI

SEQ ID NO: 6335 - protein, 98 aa, Unknown
  Sequence found in Organisms: Ambrosia trifida, Flaveria ramosissima, Helianthus annuus
MLGGPGLESVVDQLISVITNDGRNIVGILKGFDQATNIILDESHERVYSTKEGVQQLVLGLYIIRGDNISIIGELDEELDASLDLSEVRAHPLKPVIH

SEQ ID NO: 6336 - protein, 98 aa, Brassica rapa
MATTTGLESLVDQIISVITNDGRNIVGVLKGFDQATNIILDESHERVFSTKEGVQQLVLGLYIIRGDNIGVIGELDEELDASLDFSKLRAHPLKPVVH

SEQ ID NO: 6337 - protein, 98 aa, Unknown
  Sequence found in Organisms: Euphorbia peplus, Euphorbia esula
MSTGPGLESLVDQNISVITNDGRNIVGILKGFDQATNIILDESHERVYSTKEGVQRLVLGLYIIRGDNISIVGEVDEELDLKLDLPNIKAHPLKPVIH

SEQ ID NO: 6338 - protein, 99 aa, Euphorbia peplus
MSTGGPGLESLVDQNISVITNDGRNIVGILKGFDQATNIILDESHERVYSTKEGVQLIVLGLYIIRGDNISIVGELDEELELNLDLKALRAHPLKPVIH

SEQ ID NO: 6339 - protein, 98 aa, Eutrema halophilum
MAATTGLESLVDQMISVITNDGRNIVGVLKGFDQATNIILDESHERVFSTKEGVQQLVLGLYIIRGDNIGVIGELDEELDASLDFSKLRAHPLKPVVH

SEQ ID NO: 6340 - protein, 98 aa, Artemisia annua
MLGGPGLESVVDQYISVITNDGRNIVGILKGFDQATNIILDESHERVYSTKEGVQQLVLGLYIIRGDNISVIGELDEELDAGLNLSELRAHPLKPIIH

SEQ ID NO: 6341 - protein, 98 aa, Raphanus sativus
MAATTGLESLVDQIISVITNDGRNIVGVLRGFDQATNIILNESHERVFSTKEGVQQLVLGLYIIRGDNIGVIGELDEELDASLDLSKLRAHPLKPVVH

SEQ ID NO: 6342 - protein, 98 aa, Zostera marina
MAAASTLESLVDQMISVITNDGRNIVGILKGFDQATNIILDESHERVYSTREGVQQLVLGLYIIRGDNISVVGELDEDLDSNLDLSTVKAHPLKPVIH

SEQ ID NO: 6343 - protein, 101 aa, Valeriana officinalis
MSSGTGGTGLESLVDQIISVITNDGRNIVGVLKGFDQATNIILDESHERVYSTKEGVQQLVLGLYIIRGDNISIVGELDEELDASLELSKVRAHPLKPVIH

SEQ ID NO: 6344 - protein, 102 aa, Castanea mollissima
MSGGPGLESLVDQTISVITNDGRNIVGVLKGFDQATNIILDESHERVYSTKEGVQQLVLGLYIIRGDNISVVGELDEDLDAHLVFVQNWRAHPLKPVIQLKD

SEQ ID NO: 6345 - protein, 89 aa, Setaria italica
VLLLLLQRSSPSSPTMAATSWARSEDLTRPPTLSSTSPTRGSIRQRRESSNLYIIRGDNISVVGEVDEDLDARLDLSKLRAHPLKPVIH

SEQ ID NO: 6346 - protein, 98 aa, Primula obconica
MSAGPGLESLVDQQISIITNDGRNIVGILKGFDQATNVILDESHERVYSTREGVQQVVLGLYIIRGDNISIVGELDEELDASLDLSKVRAHPLKPVIH

SEQ ID NO: 6347 - protein, 98 aa, Arabidopsis thaliana
MAATTGLETLVDQIISVITNDGRNIVGVLKGFDQATNIILDESHERVFSTKEGVQQHVLGLYIIRGDNIGVIGELDEELDASLDFSKLRAHPLKPVVH

SEQ ID NO: 6348 - protein, 98 aa, Unknown
  Sequence found in Organisms: Brassica napus, Brassica juncea, Brassica oleracea, Brassica rapa
MATTTGLESLVDQIISVITNDGRNIVGVLKGFDQATNIILDESHERVFSTKEGVQQHVLGLYIIRGDNIGVIGELDEELDASLDFSKLRAHPLKPVVH

SEQ ID NO: 6349 - protein, 98 aa, Ricinus communis
MSTGPGLESLVDQNISVITNDGRNIVGILKGFDQATNIILDESHERVYSTKEGVQLHVLGLYIIRGDNISIVGELDEELDSNLDLASLRAHPLKPLIP

SEQ ID NO: 6350 - protein, 98 aa, Lactuca sativa
MLGGPGLESVVDQIISVITNDGRNIVGVLKGFDQATNIILDESHERVYSTKEGVQQLVLGLYIIRGDNISIIGELDEELDASLDLAELRAHPLRPVIH

SEQ ID NO: 6351 - protein, 98 aa, Lotus japonicus
MSTGPGLESLVDQQISVITNDGRNIVGTLKGFDQATNIILDESHERVFSTKEGVQLIALGLYIIRGDNISVVGELDEDLDKNLDKSKIRAQPLKPVIH

SEQ ID NO: 6352 - protein, 98 aa, Carica papaya
MSSGLGLESLVDHTISVITNDGRNIVGILKGFDQATNIILDESHERVFSTKEGVQQLVLGLYIIRGDNISVIGELNEELDASLDLSKLRAHPLKPVVH

SEQ ID NO: 6353 - protein, 98 aa, Raphanus sativus
MATTTGLESLVDQIISVITNDGRNIVGLLKGFDQATNIILDESHERVFSTKEGVQQHVLGLYIIRGDNIGVIGELDEELDASLDFSKLRAHPLKPVVH

SEQ ID NO: 6354 - protein, 97 aa, Sequoia sempervirens
MSIAGLDSMMDQVISVITNDGRNIVGILRGFDQATNLILDESHERVYSTTAGVEQLVLGLYIIRGDNISVVGELDEELDSNLDLSKLRAHPLKPVVH

SEQ ID NO: 6355 - protein, 637 aa, Sorghum bicolor
MACLAISLQPVNGPDILLQTRSWFPVSRALAAVSAFRLARLHLARGKQQSSSSSASSASLDAIGDDPLAAASGQLVVGVESQYRVVYRLVNSIYVLGVTTAGSDHAAPAVNAFAVADAVNQAVSVVVAACRGVDVTPEKVHRKYPEVYLALDLVLHGVGSVRLSQILATIHGDNLARMVNSSPDAEARARGADPWPAVEHLAQDRHAAREGFSGASFELPQETLAAGDEFSSNIAPATTVATGDEPPPEEAAPVEKDPFAASDLINNKPEEALVGGFKKNKETALVVADPAAALAGLEVTTLPPAEATKPTFIGVEGFEGDYGGIEFGNDEASLAEAFEGLNAPFGGGLDASEFVTTTKKDHKDRAVTGLELLVSSGKPPNAAAGTPLENLLVTKRTEMTAPELFIAEEINAEFKESILVRVGLKGTIFLRTLPLNKAAGKETEFSFRLEGTSGMKRAALQSNVLSNLQNGLFHVRTVSKEEPIPLMKYSFLPKHSPLPLRMRLVKRHSGTLLSVMIQYASNPMLPQPLSNVTFIVKLPVDPTLLNVSPKAVLNRAERELRWHISEIPLKGPAGRLRARMPVDQDSKDGELEVVGMVKFAYQGPFTLSGIKLRPATDGIAQFNEVGHTFSSGSYLCI

SEQ ID NO: 6356 - protein, 640 aa, Setaria italica
MACLAISLQPVNGPDILLQTRSWFPVSRALAAVSAFRLARLHLARGKQQSAAAAASASSSASLDAIGDDPLAAGSGQLVVGVESQYRVVYRLVNSIYVLGVTTAGSDHAAPAVHAFAVADAVNQAVSVVVAACRGVDVTPEKVHRKYPEVYLALDLVLHGVGSVRLSQILATIHGDNLARMVNSSPDAEARARGADSWPTVEHLAQDRHAAREGFSGASFELPQETLAAGDEFSSNIAPATTVATGDEPPPEEAPPVEKDPFAASDLINNKPEEALVGGFKKNKETALVVADPAAALAGLEVTTLPPAEATKPTFIGVEGFEGDYGGIEFGNEEASLAEAFEGFNAPFGGGLDASEFVTTTKKDHKDRAVTGLELLATSGQPPNAAGGTPLENLLVTKRTEMTAPELFIAEEINAEFKESILVRVGLKGTIFLRTLPLNKAAGKETEFSFRLEGTSGMKRAALQSNVLSNLQNGLFHVRTVSKEEPIPLLKYSFLPKHSPLPLRMRLVKRHSGTLLSVMIQYASNPMLPQPLSNVTFIVKLPVDPTLLNVSPKAVLNRAERELRWHISDIPLKGPAGRLRARMPVDQDSKDGELEVLGMVKFAYQGPFTLSGIKLRPATDGIAQFNEVGHTFSSGSYLCI

SEQ ID NO: 6357 - protein, 641 aa, Oryza sativa
MACLAISLQPVNGPDILLQTRSWFPVSRALAAVSSFRLARLHLARGKQQQLSSSSSAAAAAATLEAIGDDPLAAGSGQLVVGVESQYRVVYRLVNSIYVLGVTTSSDHASPAVHAFAVADAVNQAVSVVVAACRGVDVTPEKVHRKYPEVYLALDLVLHGVGSVRLSQILATIHGDNLARMVNSSPDAEAKARGADPWPAVEHLAHDRHAARDGFTGASFELPQETLAAGDEFSASNIAPAAAAATGDEPPPEEAAPVEKDPFAASELVNNSEEALVGGFKKNKETAIVVADPAAALAGLEVTTLPPAEATKPTFIGVEGFEGDYGGIEFGNEEASLAEAFEGFNAPFGGGLDASEFVTTTKKDHKDKSITGLELLATSAGQGPNAPGGTPLENLLVTKSTEMTAPELYIVEEVNAEFKESILARVGLKGTIFLRTLPPKKAAGKETEFSFRLEGTSGMKKAALQSTVLSNLENGMFHVRTPSKEEPIPIMKYSFLPKHSPLPLRMRLVKRHSGTLLSVMIQYASNPMLPQPLSNVTFIVKLPVDPTLLNVSPKAVLNRAERELRWHIPDIPLKGPAGRLRARMPVDQDSKDGELEVVGMVKFAYQGPFTLSGIKLCPATDGTAQFNEAGHTFSSGSYLCI

SEQ ID NO: 6358 - protein, 633 aa, Brachypodium distachyon
MACLAISLQPVNGPDILLQTRSWFPVSRALAAVSAFRLARLHLARGKQQPASHASLDAIGDDPLAAGSGQLVVGVESQYRVVYRLVNSIYVLGVTTASDHASPAVHAFAVADAVNQAVSVVVAACRGVDVTPEKVHRKYPEVYLALDLVIHGVGSVRLSQILATIHGDNLARMVNSSPDAEARARGADSWPTVEHLAQDRHAARDAFTGASFELPLETLAAGDEFSASSLAPAAAATTGDEAPPEDAPPVEKDPFAASDMVSKPEEALVGGFKKNKETALVVADPAAALAGLEVTTLPPAEATKPTFIGVEGFEGDYGGIEFGNEEASLAEAFEGFNAPFGGGLDASEFVTTTKKDHKDKSITGLELLAMGGGQALNAAAGSPLENLLVTKSAEMTVPELYIVEEINAEFKESILARVGLKGTIFLRTLPPKKAAGRDTEFSFRLEGTSGMKRAALQSTVLSNLENGLFHVKTPSKEEPIPIMKYSFLPKHSPLPLRMRLVKRHSGTLLSVMIHYASNPILPQPLSNVTFIVKLPVDPTLLNVSPKAVLNRAERELRWHIADIPLKGPAGRLRARMPVDQDSKDGELEVVGMVKFTYQGPFTLSGIKLCPAINSTAQFNQVGHTFSSGSYRCI

SEQ ID NO: 6359 - protein, 334 aa, Secale cereale
QPVNGPDILLQTRSWFPVSRALAAVSAFRLARLSLARGKQHSSAALDAIGDDPLATGSGQLVVGVESQYRVVYRLVNSIYVLGVTTASDHASPAVHAFAVADAVNQAVSVVVAACRGVDVTPDKVHRKYPEVYLALDLVLHGVGSVRLSQILATIHGDNLARMVNSPPTPRPAPAAPTPGPSSSTSRRTATPPATPSPAPPSSSPRRPSLPAMSSLLPASRLRLLRLLGMSRRLRRRPPLRRTPLQPATWLLASQRRPWSVRSRRTRRLHLWLLILLLRLLGWRSPLCLQLRQRNQRSLGSRDSRVTTVELSLVMRKLHWLRHLKASMRHLGVG

SEQ ID NO: 6360 - protein, 640 aa, Secale cereale
PTDPRPTIRPPRWRALPISLQPVNGPDILLQTRSWFPVSRALAAVSAFRLARLSLARGKQHSSAALDAIGDDPLATGSGQLVVGVESQYRVVYRLVNSIYVLGVTTASDHASPAVHAFAVADAVNQAVSVVVAACRGVDVTPDKVHRKYPEVYLALDLVLHGVGSVRLSQILATIHGDNLARMVNSSPDAEARARGADSWTVVEHLAQDRHAARDAFTGASFELPQETLSAGDEFAASSLAPAATGDEPPPEEAPPVEKDPFAASDMVVSKPEEALVGAFKKNKETALVVADPAAALAGLEVTTLPPAEATKPTFIGVEGFEGDYGGIEFGNEEASLAEAFEGFNAPFGGGLDASEFVTTTKKDHKDKTLTGLELLAMSQAPNAASSGSQLDSLLVTPSKEMTVPELCIVEEINAEFNESVLARVGLKGTIFLRTLPPKKAAGRETEFSFRLEGTSGMKRAALQSTVLSSLENGLFHVKTPSKEEPIPIMKYSFLPKHSPLPLRMRLVKRHSGTLLSLMIHYASNPMLPQPLSNVTFIVKLPVDPTLLNVSPKAVLNRAERELRWHISDIPLKGPAGRLRARMPVDQDSKDGELEVVGMVKFAYQGPFTLSGIKLCPAINSTAQFNEVGHTFSSGSYRCI

SEQ ID NO: 6361 - protein, 494 aa, Sorghum bicolor
MVGSVGNGLADLGAAGAVSMNGVGKPLHPAEAAAAVETLPMELEPPEALVAAAAEAKREEAGANGRRREIVMGRNVHTSCFAVKEPDADDEETGEREATMASVLALYRRSLVERTKHHLGYPYNLDFDYGALAQLQHFSINNLGDPFIESNYGVHSRQFEVGVLDWFARLWELEKDEYWGYITNCGTEGNLHGILVGREVFPDGILYASRESHYSVFKAARMYRMDCVKVDTLMSGEIDCADFHRKLLQNRDKPAIINVNIGTTVKGAVDDLDLVIKTLEENGFKDRFYIHCDGALFGLMIPFVKKAPQVTFKKPIGSVSVSGHKFVGCPMPCGVQITRLEHINALSSNVEYLASRDATIMGSRNGHAPIFLWYTLNRKGYRGFQKEVQKCLRNAHYLKDRLKEAGVGAMLNELSSTVVFERPKDEEFVRRWQLACEGNIAHVVVMPSVNIDKLDYFLNELVEKRATWYQDGISQPPCIARDVGVENCLCGLHK

SEQ ID NO: 6362 - protein, 494 aa, Sorghum bicolor
MVGSVGNGLADLGAAGAVSMNGVGKPLHPAEAAAAVETLPMELEPPEALVAAAAEAKREEAGANGRRRVIVMGRNVHTSCFAVKEPDADDEETGEREATMASVLALYRRSLVERTKHHLGYPYNLDFDYGALAQLQHFSINNLGDPFIESNYGVHSRQFEVGVLDWFARLWELEKDEYWGYITNCGTEGNLHGILVGREVFPDGILYASRESHYSVFKAARMYRMDCVKVDTLMSGEIDCADFHRKLLQNRDKPAIINVNIGTTVKGAVDDLDLVIKTLEENGFKDRFYIHCDGALFGLMIPFVKKAPQVTFKKPIGSVSVSGHKFVGCPMPCGVQITRLEHINALSSNVEYLASRDATIMGSRNGHAPIFLWYTLNRKGYRGFQKEVQKCLRNAHYLKDRLKEAGVGAMLNELSSTVVFERPKDEEFVRRWQLACEGNIAHVVVMPSVNIDKLDYFLNELVEKRATWYQDGISQPPCIARDVGVENCLCGLHK

SEQ ID NO: 6363 - protein, 480 aa, Panicum virgatum
MVGSVGNGLADLGASMNGNGKAAAEPLPMEMDPPADVMAAAAAAEGEAASNGRREIVMGRNVHTSCFAVKEPDADDEETGEREATMASVLALYRRSLVERTKHHLGYPYNLDFDYGALGQLQHFSINNLGDPFIESNYGVHSRQFEVGVLDWFARLWDLEKDKYWGYITNCGTEGNLHGILVGREVFPDGILYASRESHYSVFKAARMYRMDCVKVDTLMSGEIDCADFQRKILQNRDKPAIINVNIGTTVKGAVDDLDLVIKTLEESGFKDRFYIHCDGALFGLMIPFVKKAPKVTFKKPIGSVSVSGHKFVGCPMPCGVQITRLKHINALSSNVEYLASRDATIMGSRNGHAPIFLWYTLNRKGYRGFQKEVQKCLRNAHYLKDRLKEAGIGAMLNELSSTVVFERPKDEEFVRRWQLACEGNIAHVVVMPSVNIDKLDYFLNELVEKRATWYKDGISKPPCIARDLGVENCLCGLHK

SEQ ID NO: 6364 - protein, 489 aa, Setaria italica
MVGSVGNGLADLGASMNGVGKVAAADPLPMEMEPPADVVVVAAAAAAAAEGGKAEGPTSNGRREIVMGRNVHTSCFAVKEPDADDEVTGEREATMASVLALYRRSLVERTKHHLGYPYNLDFDYGALGQLQHFSINNLGDPFIESNYGVHSRQFEVGVLDWFARLWELEKDEYWGYITNCGTEGNLHGILVGREVFPDGILYASRESHYSVFKAARMYRMDCVKVDTLMSGEIDCADFQRKILQNRDKPAIINVNIGTTVKGAVDDLDLVIKTLEESGFKDRFYIHCDGALFGLMIPFVKKAPKVTFKKPIGSVSVSGHKFVGCPMPCGVQITRLEHINVLSSNVEYLASRDATIMGSRNGHAPIFLWYTLNRKGYVGFQKEVQKCLRNAHYLKDRLKEAGIGAMLNELSSTVVFERPKDEEFVRRWQLACEGNIAHVVVMPSVNIDKLDYFLTELVEKRATWYQDGISKPPCLARDLGVENCLCGLHK

SEQ ID NO: 6365 - protein, 484 aa, Avena sativa
MVGSVGNGTLDLAGAASLLANGNGKAPLHPEEPTAAAAAAAEALPMEVDPDMVEGKREVVMGRNMHTACFAVKEPDADDEETGEREATMASVLALYRRSLVERTKHHLGYPYNLDFDYGALAQLQHFSINNLGDPFIESNYGVHSRQFEVGVLDWFARLWELEKDEYWGYITNCGTEGNLHGILVGREVFPEGILYASRESHYSVFKAARMYRMECVKVDTHISGEINCSDFERKLMQNKDKPAIINVNIGTTVKGAVDDLDLVIKTLEESGFRDRFYIHCDGALFGLMIPFVKKAAKVTFKKPIGSVSVSGHKFVGCPMPCGVQITRLEHINALSSNVEYLASRDATIMGSRNGHAPIFLWYTLNRKGYRGFQKEVQKCLRNAHYLKDRLNAAGIGAMLNELSSTVVFERPKDEEFVRRWQLACEGNIAHVVVMPSVNIDKLDYFLRELVEKRAVWYKDGICQPPCIARDVGQESCFCSLHKK

SEQ ID NO: 6366 - protein, 482 aa, Oryza sativa
MVGSVGNGLVDLGGAAVAVNGVGKGMRPEAVAVAMEVESPPRPAEEEGEGSPTRREIVLGRNVHTASFAVKEPDADDEETGEREAAMASVLALYRRNLVERTKHHLGYPYNLDFDYGALGQLQHFSINNLGDPFIESNYGVHSRQFEVGVLDWFARIWELEKNEYWGYITNCGTEGNLHGILVGREVFPDGILYASRESHYSVFKAARMYRMDCVKVDTLISGEIDCEDFQRKLLLNRDKPAIINVNIGTTVKGAVDDLDLVIKTLEEGGFKDRFYIHCDGALFGLMIPFVKKAPKVSFKKPIGSVSVSGHKFVGCPMPCGVQITRLEHINRLSSNVEYLASRDATIMGSRNGHAPIFLWYTLNRKGYRGFQKEVQKCLRNAHYLKDRLKEAGIGAMLNELSSTVVFERPKDEEFVRRWQLACEGNIAHVVVMPSVTIDKLDYFLNELTEKRATWYQDGSCQPPCLAKDVGEENCLCSIHKK

SEQ ID NO: 6367 - protein, 470 aa, Brachypodium distachyon
MVGSVGNGTVDLHAVNGNGKALHLEGEAAAAEALPMEVEPGKREVVLGRNVHMTCFEVKEPDADDEETGEREATMASVLALYRRSLVERTKHHLGYPYNLDFDYGALAQLQHFSINNLGDPFIESNYGVHSRQFEVGVLDWFARLWELEKDEYWGYITNCGTEGNLHGILVGREVFPDGILYASRESHYSVFKAARMYRMECVKVDTHISGEIDCSDFERKLLQNRDKPAIINVNIGTTVKGAVDDLDLVIKTLEESGFQGRFYIHCDGALFGLMIPFVKKAAKVTFKKPIGSVSVSGHKFVGCPMPCGVQITRLEHINALSSNVEYLASRDATIMGSRNGHAPIFLWYTLNRKGYRGFQKEVQKCLRNAHYLKDRLNAAGIGAMLNELSSTVVFERPKDEEFVRRWQLACEGNIAHVVVMPSVTIDKLDYFLRELVEKRAVWYKDGICQPPCIARDVGEKSCFCSLHKN

SEQ ID NO: 6368 - protein, 466 aa, Triticum aestivum
MTGTIANGVAAPTGPGLREKAAAAPLPEELTPEVVEGEREIVLGRNMHASCFAVKEPDADDEFTGEREATMAGVLARYRRSLVERTKHHLGYPYNLDFEYGALSQLQHFSINNLGDPFIESNYGVHSRQFEVGVLDWFARLWDLEKDEYWGYITNCGTEGNLHGILVGREVFPDGILYASRDSHYSVFKAARMYRMDCVKVDTLVSGEIDCADFGRKLLENKDKPAIINVNIGTTVKGAVDDLDLVIETLEKSGFKDRFYIHCDGALFGLMMPFVKQAPRVSFKKPIGSVSVSGHKFVGCPMPCGVQITRLNHINALSSNVEYLASRDATIMGSRNGHAPIFLWYTLNRKGYRGFQKEVQKCLRNAHYLKDRLKDAGISAMLNELSSTVVFERPKDEEFVRRWQLACEGSISHVVVMPSVNVDKLDTFLNELVEKRVTWYQEGKCQSPCIAADVGQENCLCTLHKT

SEQ ID NO: 6369 - protein, 467 aa, Secale cereale
MTGSVANGVAAPGGPGLAEKKAAAAPLPEELAPEVVEGAREIVLGRNMHASCFAVKEPDADDEFTGEREATMAGVLARYRRSLVERTKHHLGYPYNLDFEYGALSQLQHFSINNLGDPFIESNYGVHSRQFEVGVLDWFARLWDLEKDEYWGYITNCGTEGNLHGILVGREVYPDGILYASRDSHYSVFKAARMYRMDCVKVDTLVSGEIDCTDFGKKLLENKDKPAIINVNIGTTVKGAVDDLDLVIETLEKSGFKDRFYIHCDGALFGLMMPFVKQAPRVSFKKPIGSVSVSGHKFVGCPMPCGVQITRLNHINALSSNVEYLASRDATIMGSRNGHAPIFLWYTLNRKGYRGFQKEVQKCLRNAHYLKDRLKDAGISAMLNELSSTVVFERPKDEEFVRRWQLACEGSISHVVVMPSVTVDKLDTFLNELVEKRITWYQEGKCQSPCIAADVGQENCLCTLHKT

SEQ ID NO: 6370 - protein, 464 aa, Secale cereale
SVANGVAAPGGPGLAEKKAAAAPLPEELAPEVVEGAREIVLGRNMHASCFAVKEPDADDEFTGEREATMAGVLARYRRSLVERTKHHLGYPYNLDFEYGALSQLQHFSINNLGDPFIESNYGVHSRQFEVGVLDWFARLWDLEKDEYWGYITNCGTEGNLHGILVGREVYPDGILYASRDSHYSVFKAARMYRMDCVKVDTLVSGEIDCTDFGKKLLENKDKPAIINVNIGTTVKGAVDDLDLVIETLEKSGFKDRFYIHCDGALFGLMMPFVKQAPRVSFKKPIGSVSVSGHKFVGCPMPCGVQITRLNHINALSSNVEYLASRDATIMGSRNGHAPIFLWYTLNRKGYRGFQKEVQKCLRNAHYLKDRLKDAGISAMLNELSSTVVFERPKDEEFVRRWQLACEGSISHVVVMPSVTVDKLDTFLNELVEKRVTWYQEGKCQSPCIAADVGQENCLCTLHKT

SEQ ID NO: 6371 - protein, 159 aa, Saccharum officinarum
MAAVVRGVLRGIKEKGLTNFIRDVRDEGYFKCLLDGNLLQTKIHNIGATLVGVDKFGNKYYEKLHGTQYGRHRWVEYAEKGRYNASQVPPEWHGWLHHITDSTGDKLLNQKTARYLVEHKQNYSGEGEELIYHSKGHALNPGQRDWTRYQPWEPKKEQA

SEQ ID NO: 6372 - protein, 159 aa, Sorghum bicolor
MAAVVRGVLRGIKEKGLTNFIRDARDEGYFKCLLDGNLLQTKIHNIGATLVGVDKFGNKYYEKLHDTQYGRHRWVEYAEKGRYNASQVPPEWHGWLHHVTDSTGDKLLNQKTARYLVEHKQNYSGEGEELIYHSKGHALNPGQRDWTRYQPWEPKKEQA

SEQ ID NO: 6373 - protein, 159 aa, Setaria italica
MAAVVRGVLRGIKEKGLTNFLRDVREEGYLNCLLDGNLLQTKIHNIGATLVGVDKFGNKYYEKLHDTQYGRHRWVEYAEKGRYNASQVPAEWHGWLHHITDNTGDQLLAQKTARYLVEHKQNYSGEGEELIYHSKGHALNPGQRDWTRYQPWEPKKEQS

SEQ ID NO: 6374 - protein, 159 aa, Pennisetum glaucum
MAAVVRGVLRGIKEKGLTNFLRDVREEGYLNCLLDGNLLQTKIHNIGATLVGVDKFGNKYYQKLHDTQYGRHRWVEYAEKGRYNASQVPPEWHGWLHHITDNTGDQLLARKTARYLVEHKQNYSGEGEELIYHSKGHALNPGQRDWTRYQPWEPKKEQA

SEQ ID NO: 6375 - protein, 161 aa, Cynodon dactylon
MAAVVRGVLRGIKEKGLSNFIRDVREEGYFKCLLDGNLLQTKIHGIGATLVGVDKFGNKYYEKLHDTQYGRHRWVEYAEKGRYNASQVPPEWHGWLHHITDSTGDKLLEQKTARYLVEHKQNFTGEGEELIYHSKGHALNPGQRDWTRYQPWEPKKVEASS

SEQ ID NO: 6376 - protein, 159 aa, Panicum virgatum
MAAVVRGVLRGIKEKGLANFLRDAREEGYLNCLLDGNLLQTKIHNIGATLVGVDKFGNKYYEKLHDTQHGRHRWVEYAEKDRYNASQVPPEWHGWLHHITDSTGDQLLAQKTARYLVEHKQNYSGEGEELIYHSKGHALNPGQRDWTRYQPWEPKKEQA

SEQ ID NO: 6377 - protein, 159 aa, Panicum virgatum
MAAVVRGVLRGIKEKGLANFLRDAREEGYLNCILDGNLLQTKIHNIGATLVGVDKFGNKYYEKLQDTQHGRHRWVEYAEKDRYNASQVPPEWHGWLHHITDNTGDQLLARKTARYLVEHKQNYSGEGEELIYHSKGHALNPGQRDWTRYQPWEPKKEQA

SEQ ID NO: 6378 - protein, 161 aa, Eragrostis curvula
  misc_feature (144)..(144): Xaa can be any naturally occurring amino acid
  misc_feature (159)..(159): Xaa can be any naturally occurring amino acid
MAAVVRGVLRGIKEKGLSNFIRDVRDEGYFKALLDGNLMQTKIHNIGATLVGTDKFGNKYYEKLNDVQYGRHRWVEYADKGRYNASQVPPEWHGWLHHITDNTGDKLLEMKTARYLVEHKQNYSGEGEELIYQSKGHALNPGQXDWTRYQPWEPKKEEXSS

SEQ ID NO: 6379 - protein, 160 aa, Oryza sativa
MAAVVRGVLNGIREKGLSNFLRHARDEGYFKCLLDGNLLQTKIHNIGATLVGVDKFGNKYYEKLHDTQYGRHRWVEYAEKGRYNASQVPPEWHGWLHHITDSTGDELLEQNAKAYIVDHKENFSGEGEELIYHSKGHALNPGQRDWTRYQPWEPKKEEAT

SEQ ID NO: 6380 - protein, 160 aa, Hordeum vulgare
MAAVVRSVWQGIKEKGLANFLRYARDEGYLKCLGDGNLLQTKIHNIGATLVGVDSFGNKYYEKLHDTQYGRHRWVEYAEKGRYNASQVPAEWHGWLHHITDSTGDKLLEEKTKKFIMEHRQNYTGQGDDLIYHSKGHALNPGQRDWTRYQPWEPKKEEAT

SEQ ID NO: 6381 - protein, 160 aa, Brachypodium distachyon
MAAVVRSVMQGIKEKGLTGFLRYARDEGYLKCLGDGNLLQTKIHNIGATLVGVDSFGNKYYEKTHDTQYGRHRWVEYAEKGRYNASQVPAEWHGWLHHITDSTGDKLLEEKTKKYIREHRQNYTGQGDDLIYHSKGHALNPGQRDWTRYQPWEPKKEEAS

SEQ ID NO: 6382 - protein, 160 aa, Pseudoroegneria spicata
MAAVVRSVWQGIREKGLTNFLRYARDEGYLKCLGDGNLLQTKIHNIGATLVGVDTFGNKYYEKLHDTQYGRHRWVEYADKGRYNASQVPAEWHGWLHHITDSTGDKLLEEKTKKFIMEHRQNYTGQGDDLIYHSKGHALNPGQRDWTRYQPWEPKKEEAT

SEQ ID NO: 6383 - protein, 160 aa, Secale cereale
MAAVVRSVWQGIREKGLANFLRYARDEGYLKCLGDGNLLQTKIHNIGATLVGVDTFGNKYYEKLHDTQYGRHRWVEYADKGRYNASQVPAEWHGWLHHITDSTGDKLLEEKTKKFIREHRQNYTGQGDDLIYHSKGHALNPGQRDWTRYQPWEPKKEEAT

SEQ ID NO: 6384 - protein, 160 aa, Festuca arundinacea
MAAVVRSVWQGIREKGLVNFFRYARDEGYLKCIPDGNLLQTKIHNIGATLVGVDSFGNKYYEKLHDTQYGRHRWVEYADKGRYNASQVPAEWHGWLHHITDSTGDKLLEEKTKKYIMEHRQNYTGQGDDLIYHSKGHALNPGQRDWTRYQPWEPKKEEAS

SEQ ID NO: 6385 - protein, 160 aa, Avena sativa
MAAVVRSVWQGIREKGLVNFFRYARDEGYLKCLPDGNLLQTKIHNIGATLVGVDSFGNKYYEKLHDTQYGRHRWVEYADKGRYNASQVPAEWHGWLHHITDSTGDKLLEEKTKKYIMEHRQNYTGQGDDLIYHSKGHALNPGQRDWTRYQPWEPKKEETS

SEQ ID NO: 6386 - protein, 160 aa, Avena sativa
MAAVVRSVWQGIREKGLVNFLRYARDEGYLKCLPDGNLLQTKIHNIGATLVGVDSFGNKYYEKLHDTQYGRHRWVEYADKGRYNASQVPAEWHGWLHHITDSTGDKLLEEKTKKYIMEHRQNYTGQGDDLIYHSKGHALNPGQRDWTRYQPWEPKKEETS

SEQ ID NO: 6387 - protein, 102 aa, Secale cereale
RERERHRIGGSAIERKRRESGGGGEGIIHGRGGPERVAGHQGEGPRKLPPLRPRRGIPKMPWGRKPIANQIHNIGATLVGVDTFGNKYYENYMTLSMEGIGG

SEQ ID NO: 6388 - protein, 157 aa, Elaeis guineensis
MASVVRGVFKAIREKGIGNFVKELREEGYTKCLLDGNLLQTKIHNIGATLVGVDKFGNKYYEKLQDTQYGRHRWVEYAEKGRYNASQVPPEWHGWLHHITDHTGDELLMLKPKRYGVEHKENFSGEGDEYIYHSKGHALNPGQRDWTRYQPWQPTKN

SEQ ID NO: 6389 - protein, 211 aa, Sorghum bicolor
MGEQENNKIGGGGGNHAMAVDEAAAAAKGKSLGAADPRLQGISDAIRVVPHFPKPGIMFNDITELLLRPGVFKDAVDMFVERYRGMGIAAVAGIEARGFIFGPAIALAIGAKFIPLRKPKKLPGEVFSESYVLEYGMDCLEMHVGAIEPGERVVVVDDLVATGGTLSAAIRLLERAGANVVECACLIGLPKFKDFYKLNGKPVYILVESRK

SEQ ID NO: 6390 - protein, 211 aa, Saccharum officinarum
MGEQENNKIGGGGNNAMAVDEAVAAAKGKKSLGAADPRLQGISDAIRVVPHFPKPGIMFNDITELLLRPGVFKDAVDMFVERYRGMGIAAIAGIEARGFIFGPAIALAIGAKFIPLRKPKKLPGEVFSESYVLEYGMDCLEMHVGAVEPGERVVVVDDLVATGGTLSAAIRLLERAGANVVECACLIGLPKFKDFYKLNGKPVYILVESRK

SEQ ID NO: 6391 - protein, 211 aa, Panicum virgatum
MGEQENNKTGGGNNAMAVADEASAAAAKEKGRGAADPRLQGISDAIRVVPHFPKPGIMFNDITPLLLRPAVFKDAVDMFVERYRGMGIAAVAGIEARGFIFGPAIALAIGAKFIPLRKPKKLPGDVFSESYVLEYGTDCLEMHVGAIEPGERAVVVDDLVATGGTLSAAIRLLERAGADVVECACLIGLPKFKDFYKLNGKPVYILVESRK

SEQ ID NO: 6392 - protein, 212 aa, Pennisetum glaucum
MGEQENNKAAGGNNAMAVVDEAAPAADKEKAGRAAADPRLQGISDAIRVVPHFPKPGIMFNDITPLLLRPAVFKDAVDMFVERYRGMGIAAVAGIEARGFIFGPAIALAIGAKFIPLRKPKKLPGDVFSESYVLEYGTDCLEMHVGAIKPGERAVVVDDLVATGGTLSAAIRLLERAGADVVECACLIGLPKFKDFYELNGKPVYILVESRK

SEQ ID NO: 6393 - protein, 211 aa, Setaria italica
MGEQENNNAGGGNNAMAVVDEAPAAAKEKAGRAAGDPRLQGISDAIRVVPHFPKPGIMFNDITPLLLRPAVFKDAVDMFVERYRGMDIAAVAGIEARGFIFGPAIALAIGAKFIPLRKPKKLPGDAFSESYVLEYGTDCLEMHVGAIEPGERAVVVDDLVATGGTLSAAIRLLERAGADVVECACLIGLPKFKDFYKLNGKPVYILVESRK

SEQ ID NO: 6394 - protein, 203 aa, Brachypodium distachyon
MGQQEKSGETGGGNMEEAAAKENGRAADPRLQGISDAIRVVPHFPKPGIMFNDITALLLRPGVFKDAVDMFVERYRGMGIAAVAGIEARGFVFGPAIALAIGAKFIPLRKPGKLPGEVISETYVLEYGTDCLEMHVGATEQGERVVVVDDLVATGGTLSAAIRLLERAGADVVECACLIGLPKFKDFYKLNGKPVYILVESRK

SEQ ID NO: 6395 - protein, 206 aa, Triticum aestivum
MGEQGTSGSEGGGSMVEAQAPAKKGDGRAADPRLQGISDAIRVVPHFPKPGIMFNDITALLLRPGVFKDAVDMFVERYRGMGIAAVAGIEARGFIFGPAIALAIGAKFIPLRKPGKLPGEVISETYTLEYGTDCLEMHVGAVEPGDRVVVVDDLVATGGTLSAAIKLLERAAADVVECACLIGLPKFKDFYKLDGKPVYILVESRK

SEQ ID NO: 6396 - protein, 209 aa, Secale cereale
MGEQDPSGSEGGGSVVEAQAPAKKGGGGHGRAADPRLQGISDAIRVVPHFPKPGIMFNDITALLLRPGVFKDAVDMFVERYRGMGIAAVAGIEARGFIFGPAIALAIGAKFIPLRKPGKLPGEVISETYTLEYGTDCLEMHVGAVEPGDRVVVVDDLVATGGTLSAAIKLLERAAADVVECACLIGLPKFKDFYKLDGKPVYVLVESRK

SEQ ID NO: 6397 - protein, 209 aa, Pseudoroegneria spicata
  misc_feature (25)..(25): Xaa can be any naturally occurring amino acid
MGEQDTSGSEGGGNVVEAQAPAPSXKNGDGRAADPRLQGIFDAIRVVPHFPKPGIMFNDITALLLRPGVFKDAVDMFVERYRGMGIVAVAGIEARGFIFGPAIALAIGAKFIPLRKPGKLPGEVISETYTLEYGTDCLEMHVGAVEPGDRVVVVDDLVATGGTLCAAIKLLERAAADVVECACLIGLPKFKDFYKLDGKPVYILVESRK

SEQ ID NO: 6398 - protein, 204 aa, Secale cereale
MGEQDPSGSVVEAQAPAKKGGGGHGRAADPRLQGISDAIRVVPHFPKPGIMFNDITALLLRPGVFKDAVDMFVERYRGMGIAAVAGIEARGFIFGPAIALAIGAKFIPLRKPGKLPGEVISETYTLEYGTDCLEMHVGAVEHGDRVVVVDDLVATGGTLSAAIKLLERAAADVVECACLIGLPKFKDFYKLDGKPVYVLVESRK

SEQ ID NO: 6399 - protein, 1086 aa, Sorghum bicolor
MAEIAERAVAGELPEEPRPPHGEEEDEEEEEEGDVCRICRNRGDEDHPLRYPCACSGSIKFVHQDCLLQWLDHSNSRQCEVCKHAFSFSPVYAENAPTRLPFQELIVGVGMKACHVFQFILRLAFVLSVWLMIIPFITYWIWRLTFVRSLGEAQRLFLSHISAQLILSDCLHGFLLSAIIVLIFLGATSLRDYIRHLRELGGHDAERDDGGRERHGARAVRRLAGPNNRVPGDANIDELAEAQGIGPGELLRRNAENVAARLERLEAQVEQMLDGLDDADGAEDVPFDELVGMQGPVFHLVENAITVLASNAIFLIVVIFVPFSLGRIVLYYLSWFFSSASTPMLAKMMPFTETAISIANDTLKSALNVVKNFSSDSNNEGVIGHVIEVVTQSLKINATGLSVIQGTGKSSLMKGTTIGSSYLSDLTTLAVGYMFIFCLVFLYIGSLALLRYARGERFTIGRLYGIATILEAIPSLCRQFFAGMKHLMTMVKVAFLLVIELGVFPLMCGWWLDVCTLKMLGTTIAQRVEFFTMSPLASSSIHWLVGIVYMLQISIFVSLLRGVLRNGVLYFLRDPADPNYNPFRDLIDDPVHKHARRVLLSVAVYGSLIVMLVFLPVKLAMRVAPSIFPLDITIFDPFTEIPVDVLLFQICIPFAIEHFKPRATIKSLLHHWFAAVGWALGLTDFLLPKPEENGGQENWNGRAERRDRGHGGREMVAPQVEQRMIQHVAAEDNGRGNANEANDATEESDVDDQGDSEYGFVLRIVLLLVLAWVTLLIFNAGMIVIPISLGRLVFEAVPRLPITHGIKCNDLFSFSIGCYILWSAAAGTRYAIDYIRSRQLGFLVQQICKWCSIVLKSSFLLSIWIFVIPVLIGLLFELLVIVPMRVPIDESPVFLLYQDWALGLIFLKIWTRLVMLDQMAPLVDESWRSKFERVRDDGFSRLRGLWVLHEIIMPIVTKLLTALCVPYVLARGIFPVLGYPLIVNSAVYRFAWLGCLIFSALFFCGKRFHVWFTNLHNSIRDDRYLIGRRLHNFGEDSHSPEPSESGATIGSDDQDRALVLRDQEEDVGLRMRRNNMRANQQPRLAL

SEQ ID NO: 6400 - protein, 1083 aa, Zea mays
MAEMAERSVAGELPEEPRPPHGEEDDEEEEEGDVCRICRNRGDEDHPLRYPCACSGSIKFVHQDCLLQWLDHSNSRQCEVCKHAFSFSPVYADNAPTRLPFQELIVGVGMKACHVFQFILRLAFVLSVWLMIIPFITYWIWRLTLVRSIGEAQRLFLSHISAQLILSDCLHGFLLSAIIVLIFLGATSLRDYIRHLRELGGHDAERDDGGRERHGARAVRRLAGPNNRVPADGNIDELAEAQGIGAGELLRRNAENVAARLERLEAQVEQMLDGLDDADGAEDVPFDELVGMQGPVFHLVENAITVLASNAIFLIVVIFVPFSLGRIVLYYLSWFFSSASTPMLAKMMPFTETAISIANDTLKSALNVVKNFSSDSNNEGVIGHVIEVVTQSLKINATGLSVIQVTGKSSLMKGTAIGSSYLSDLTTLAVGYMFIFCLVLLYIGSLALLRYARGERFTIGRLYGIATILEAIPSLCRQFFAGMKHIMTMVKVAFLLVIELGVFPLMCGWWLDVCTLKMLGTTIAQRIEFFTVSPLASSSIHWLVGIVYMLQISIFVSLLRGVLRNGVLYFLRDPADPNYNPFRDLIDDPVHKHARRVLLSVAVYGSLIVMLVFLPVKLAMRVAPSIFPLDITIFDPFTEIPVDVLLFQICIPFAIEHFKPRATIKSLLHHWFAVVGWGLGLTDFLLPKPEENGGQENWNGRAERRDRGHGGQEMVAPQVEQLMIQHVAAEHNDRGNANEANDVTEESDVDDQGDSEYGFVLRIVLLLVLAWMTLLIFNAGMIVIPISLGRLVFEGVPRLPITHGIKCNDLFSFSIGCYILWSVAAGTRYAIDYIRSRQLGFLVQQICKWCSIVLKSSFLLSIWIFVIPVLIGLLFELLVIVPMRVPIDESPVFLLYQDWALGLIFLKIWTRLVMLDQMAPLVDESWRSKFERVRDDGFSRLRGLWVLHEIIMPILTKLLTALCVPYVLARGIFPVLGYPLIVNSAVYRFAWLGCLIFSALFFCGKRFHVWFTNLHNSIRDDRYLIGRRLHNFGEDTPEPSESGATIGSDDQDQALVLRDQEEEVGLRMRRNNMRANQQPRLAF

SEQ ID NO: 6401 - protein, 1083 aa, Setaria italica
MAEIAERAVPGELPEEPRPPPGEEEDEEEEEGDVCRICRNRGDEDHPLRYPCACSGSIKFVHQDCLLQWLDHSNSRQCEVCKHAFSFSPVYADNAPTRLPFQELIVGVGMKACHVFQFILRLAFVLSVWLMIIPFITYWIWRLTFVRSLGEAQRLFLSHISAQLILSDCLHGFLLSAIIVLIFLGATSLRDYIRHLRELGGHDAERDDGGRERHGARAVRRLAGPNNRVPADGNIDELAEAQGIGAGELLRRNAENVAARLERLEAQVEQMLDGLDDADGAEDVPFDELVGMQGPVFHLVENAITVLASNAIFLIVVIFVPFSLGRIVLYYLSWFFSSASTPMLAKMMPFTETAISIANDTLKSALNVVKNFSSDTNNEGVIGHVIEVVTQSLKINATGLSVIQGSGRGSLIKGTAIGSSYLSDLTTLAVGYMFIFCLVFLYIGSLALLRYARGERFTIGRLYGIATILEAIPSLCRQFFAGMKHLMTMVKVAFLLVIELGVFPLMCGWWLDVCTLKMLGTTIAQRVEFFTMSPLASSSIHWLVGIVYMLQISIFVSLLRGVLRNGVLYFLRDPADPNYNPFRDLIDDPVHKHARRVLLSVAVYGSLIVMLVFLPVKLAMRVAPSIFPLDITIFDPFTEIPVDVLLFQICIPFAIEHFKPRATIKSLLHHWFAAVGWALGLTDFLLPKPEENGAQENWNGRAERRDRGHVGRELVAPQVEQRMIQHVAAEDNGRGNPNEANDVAEEPDVDDQGDSEYGFVLRIVLLLVLAWMTLLIFNAGMIVIPISLGRLVFEAVPRLPITHGIKCNDLFSFSIGCYILWSAAAGTRYAIDYIRSRQLGILVQQICKWCSIVLKSSVLLSIWIFVIPVLIGLLFELLVIVPMRVPIDESPVFLLYQDWALGLIFLKIWTRLVMLDQMAPLVDESWRSKFERVRDDGFSRLRGLWVLHEIIMPIVTKLLTALCVPYVLARGVFPVLGYPLIVNSAVYRFAWLGCLIFSALFFCGKRFHVWFTNLHNTIRDDRYLIGRRLHNFGEDTPEPSESGATIGSDDQDRALVLQDHEEEMGLRLRRNNMRANQQPRLAA

SEQ ID NO: 6402 - protein, 1088 aa, Oryza sativa
MADVAADRPPAAEQEEARPPSSTAAVAEEDEEEEEGDVCRICRNPGDDEHPLRYPCACSGSIKFVHQDCLLQWLDHSNSRQCEVCKHAFSFSPVYADNAPSRLPFQELIVGVGMKACHVLQFVLRLAFVLSVWLMIIPFITYWIWRLTFVRSLGEAQRLFLSHISAQLILSDCLHGFLLSAIIVLIFLGATSLRDYIRHLRELGGHDAERDDGGRERHGARAVRRLPGPNNRVPAADGNVDELAEAQGLGAGELLRRNAENVAARLERLEAQVEQMLDGLDDADGAEDVPFDELVGMQGPVFHLVENAITVLASNAIFLIVVIFVPFSLGRIVLYYLSWFFSSASSPMLARMMPFTETAISLANDTLKSALNAVKNLSADSHNEGVIGHVIEVVTQSLKINATGLTVMQASGKSSLIKGTAIGSSYLSDLTTLAVGYMFIFCLVFLYIGSLALLRYARGERFTIGRLYGIATILEAIPSLCRQFFAGMKHLMTMVKVAFLLVIELGVFPLMCGWWLDVCTLKMLGATIAQRVEFFTMSPLASSSIHWLVGIIYMLQISIFVSLLRGVLRNGVLYFLRDPADPNYNPFRDLIDDPVHKHARRVLLSVAVYGSLIVILVFLPVKLAMRVAPSIFPLDITIFDPFTEIPVDVLLFQICIPFAIEHFKPRATIKALLRHWFAAVGWALGLTDFLLPRHEENGGQENWNGRAGRDRVHGGREMVAPQLEQRMIQHVADNLNGRGNANDSNEVAEESDVDDQGDSEYGFVLRIVLLLVLAWMTLLIFNAGMIVIPISLGRLVFEAIPRLPITHGIKCNDLFSFSIGCYIIWSAAAGTRYAIDYIRSRRLAFLVQQICKWCSIVVKSSALLSIWIFVIPVLIGLLFELLVIVPMRVPIDESPVFLLYQDWALGLIFLKIWTRLVMLDQMAPLVDESWRTKFERVREDGFSRLRGLWVLHEIIMPIVTKLLTALCVPYVLARGVFPVLGYPLIVNSAVYRFAWLGCLIFSALFFCGKRFHVWFTNLHNSIRDDRYLIGRRLHNFGEDSLHSSEPGTTTASDDDEHEQALIPRDQEGELGLRFRRHIMRGNQPRMAA

SEQ ID NO: 6403 - protein, 1098 aa, Brachypodium distachyon
MAEIVDPAVAAAAAAGGPVVAEEEEEPRLPPAPAGGEEDDDDEEEGDVCRICRNRGDDEHPLRYPCACSGSIKFVHQDCLLQWLDHSNSRQCEVCKHAFSFSPVYAQNAPTRLPFQELVFGVGMKACHVFQFVLRLAFVLSVWLMIIPFITYWIWRLTFVRSFGEAQRLFLSHISAQLILSDCLHGFLLSAIIVLIFLGATSLRDYIRHLRELGGHEADRDDAGRERHGARAVRRLAGPNNRVPAADGNMDELAEAQGLGAGELLRRNAENVAARLERLEAQVEQMLDGLDDADGAEDVPFDELVGMQGPVFHLVENAITVLASNAIFLIVVIFVPFSLGRIVLYYLSWFFSSASSPMLAKMMPFTESAISLANDTLNNAFNAMKNFSSDSHNEGVIGHVIEVVTQSLKINATGLAVMQGAAKNSVMKGTAMGSSYLSDLTTLAVGYMFIFCLVFLYIGSLALLRYARGERFTIGRLYGIAAILEAIPSLCRQFFSGMKHLMTMVKVAFLLVIELGVFPLMCGWWLDVCTLKMLGTTIAQRVEFFTMSPFASSSIHWLVGIVYMLQISIFVSLLRGVLRNGVLYFLRDPADPNYNPFRDLIDDPVHKHARRVLLSVAVYGSLIVMLVFLPVKLAMRVAPSTFPLDITIFDPFTEIPVDVLLFQICIPFAIEHFKPRATIKALLHHWFAVIGWALGLTDFLLPKPEENGGQENWNVRAERRDRLHGGREAVALQLEQRMIQHAALDNDGRGNANEANDVAEESEADDQGDSEYGFALRIVLLLVLAWMTLLIFNAGMIVIPISLGRLVFEAVPRLPITHGIKCNDLFSFSIGCYIIWSAAAGTRYAIDYIRSRRLAFLVQQICKWCSIVLKSSALLSIWIFVIPVLIGLLFELLVIVPMRVPIDESPVFLLYQDWALGLIFLKIWTRLVMLDQMAPLVDESWRMKFERVREDGFSRLKGLWVLHEIITPIVTKLLTALCVPYVLARGVFPVLGYPLIVNSAVYRFAWLGCLIFSTLFFCGKRFHVWFTNLHNSIRDDRYLIGRRLHNFGEDSLRLNESDETPGPGGEDQALIPVDDDDVGLRFRRINRNAHEHPRMVLE

SEQ ID NO: 6404 - protein, 1066 aa, Secale cereale
DDEDDEERGTVCRICRNRGDDDHPLRYPCACSGSIKFVHQDCLLQWLDHSNSRQCEVCKHAFSFSPVYAQNAPTRLPFQELVFGVGMKACHVFQFVLRLAFVLSVWLMIIPFITYWIWRLTFVRSLGEAQRLFLSHISAQLILSDCLHGFLLSAIIVLIFLGATSLRDYIRHLRELGGHEADRDDAGRERHGARAVRRLAGPNNRVPGADGNIDDLAEAQGLGAGELLRRNAENVAARLERLEAQVEQMLDGLDDADGAEDVPFDELVGMQGPVFHLVENAITVLASNAIFLIVVIFVPFSLGRIVLYYLSWFFSSASSPMLARVMPFTESAISLANETLNSAFNAMKNFSSDSHNEGVIGHVIEVVTQSLKINATGLAVMQGTGKSSLVKGTAIGSSYLSDLTTLAVGYMFIFCLVFLYIGSLALLRYARGERFTIGRLYGIAAILEAIPSLCRQFFSGMKHLMTMVKVAFLLVIELGVFPLMCGWWLDVCTLKMLGTTIAQRVEFFTMSPLASSSIHWLVGIVYMLQISIFVSLLRGVLRNGVLYFLRDPADPNYNPFRDLIDDPVHKHARRVLLSVAVYGSLIVMLVFLPVKLAMRVAPKTFPLDITIFDPFTEIPVDVLLFQICIPFAIEHFKPRATIKALLHHWFAVIGWALGLTDFLLPKPEENAAGQENWNGRAERRDRVNGGMEMVAPQLEQRMIQHAAIDNDGRGNANEANDIAEESDVDDQGDSEYSFALRIILLLVLAWMTLLIFNAGMIVIPISLGRLVFEAVPRLPITHGIKCNDLFSFSIGCYIIWSAAAGTRYAVDYIRSRRLGFLVQQICKWCSIVLKSSALLSIWIFVIPVLIGLLFELLVIVPMRVPIDESPVFLLYQDWALGLIFLKIWTRLVMLDQMAPLVDESWRMKFERVREDGFSRLKGLWVLHEIITPIITKLLTALCVPYVLARGVFPVLGYPLIVNSAVYRFAWLGCLIFSTLFFCGKRFHVWFTNLHNSIRDDRYLIGRRLHNFGEDSRRSNVADENPGSGDEDLALIPIDHQEDDDVGLRFRGNNRHAHEDAGVVVVG

SEQ ID NO: 6405 - protein, 1051 aa, Secale cereale
NRGDDDHPLRYPCACSGSIKFVHQDCLLQWLDHSNSRQCEVCKHAFSFSPVYAQNAPTRLPFQELVFGVGMKACHVFQFVLRLAFVLSVWLMIIPFITYWIWRLTFVRSLGEAQRLFLSHISAQLILSDCLHGFLLSAIIVLIFLGATSLRDYIRHLRELGGHEADRDDAGRERHGARAVRRLAGPNNRVPGADGVIDDLAEAQGLGAGELLRRNAENVAARLERLEAQVEQMLDGLDDADGAEDVPFDELVGMQGPVFHLVENAITVLASNAIFLIVVIFVPFSLGRIVLYYLSWFFSSASSPMLARVMPFTESAISLANETLNSAFNAMKNFSSDSHNEGVIGHVIEVVTQSLKINATGLAVMQGTGKSSLVKGTAIGSSYLSDLTTLAVGYMFIFCLVFLYIGSLALLRYARGERFTIGRLYGIAAILEAIPSLCRQFFSGMKHLMTMVKVAFLLVIELGVFPLMCGWWLDVCTLKMLGTTIAQRVEFFTMSPLASSSIHWLVGIVYMLQISIFVSLLRGVLRNGVLYFLRDPADPNYNPFRDLIDDPVHKHARRVLLSVAVYGSLIVMLVFLPVKLAMRVAPKTFPLDITIFDPFTEIPVDVLLFQICIPFAIEHFKPRATIKALLHHWFAVIGWALGLTDFLLPKPEENAAGQENWNGRAERRDRVNGGMEMVAPQLEQRMIQHAAIDNDGRGNANEANDIAEESDVDDQGDSEYSFALRIILLLVLAWMTLLIFNAGMIVIPISLGRLVFEAVPRLPITHGIKCNDLFSFSIGCYIIWSAAAGTRYAVDYIRSRRLGFLVQQICKWCSIVLKSSALLSIWIFVIPVLIGLLFELLVIVPMRVPIDESPVFLLYQDWALGLIFLKIWTRLVMLDQMAPLVDESWRMKFERVREDGFSRLKGLWVLHEIITPIITKLLTALCVPYVLARGVFPVLGYPLIVNSAVYRFAWLGCLIFSTLFFCGKRFHVWFTNLHNSIRDDRYLIGRRLHNFGEDSRRSNVADENPGSGDEDLALIPIDHQEDDDDVGLRFRGNNRHAHEDAGVVVVG

SEQ ID NO: 6406 - protein, 1032 aa, Secale cereale
IKFVHQDCLLQWLDHSNSRQCEVCKHAFSFSPVYAQNAPTRLPFQELVFGVGMKACHVFQFVLRLAFVLSVWLMIIPFITYWIWRLTFVRSLGEAQRLFLSHISAQLILSDCLHGFLLSAIIVLIFLGATSLRDYIRHLRELGGHEADRDDAGRERHGARAVRRLAGPNNRVPGADGVIDDLAEAQGLGAGELLRRNAENVAARLERLEAQVEQMLDGLDDADGAEDVPFDELVGMQGPVFHLVENAITVLASNAIFLIVVIFVPFSLGRIVLYYLSWFFSSASSPMLARVMPFTESAISLANETLNSAFNAMKNFSSDSHNEGVIGHVIEVVTQSLKINATGLAVMQGTGKSSLVKGTAIGSSYLSDLTTLAVGYMFIFCLVFLYIGSLALLRYARGERFTIGRLYGIAAILEAIPSLCRQFFSGMKHLMTMVKVAFLLVIELGVFPLMCGWWLDVCTLKMLGTTIAQRVEFFTMSPLASSSIHWLVGIVYMLQISIFVSLLRGVLRNGVLYFLRDPADPNYNPFRDLIDDPVHKHARRVLLSVAVYGSLIVMLVFLPVKLAMRVAPKTFPLDITIFDPFTEIPVDVLLFQICIPFAIEHFKPRATIKALLHHWFAVIGWALGLTDFLLPKPEENAAGQENWNGRAERRDRVNGGMEMVAPQLEQRMIQHAAIDNDGRGNANEANDIAEESDVDDQGDSEYSFALRIILLLVLAWMTLLIFNAGMIVIPISLGRLVFEAVPRLPITHGIKCNDLFSFSIGCYIIWSAAAGTRYAVDYIRSRRLGFLVQQICKWCSIVLKSSALLSIWIFVIPVLIGLLFELLVIVPMRVPIDESPVFLLYQDWALGLIFLKIWTRLVMLDQMAPLVDESWRMKFERVREDGFSRLKGLWVLHEIITPIITKLLTALCVPYVLARGVFPVLGYPLIVNSAVYRFAWLGCLIFSTLFFCGKRFHVWFTNLHNSIRDDRYLIGRRLHNFGEDSRRLNVADENPGSGDDDLALIPIDHQDDDDVGLRFRGNNRHAHEDAGVVVVG

SEQ ID NO: 6407 - protein, 231 aa, Secale cereale
MASSAMICSLLASVAILSGVQQLEPRYAVDYIRSRRLGFLVQQICKWCSIVLKSSALLSIWIFVIPVLIGLLFELLVIVPMRVPIDESPVFLLYQDWALGLIFLKIWTRLVMLDQMAPLVDESWRMKFERVREDGFSRLKGLWVLHEITNPHHHKAPYSSLCSIRPCKGRVPGAGLPTDRDSAVLPFRLSRVPDIQHALLLRQEIPRLVHQPPQLHQGRPLSDWPEAAQLW

SEQ ID NO: 6408 - protein, 882 aa, Panicum virgatum
RLTFVRSLGEAQRLFLSHISAQLILSDCLHGFLLSAIIVLIFLGATSLRDYIRHLRELGGHDAERDDGVRERHGARAVRRLAGPNNRVPADGNIDELAEAQGIGAGELLRRNAENVAARLERLEAQVEQMLDGLDDADGAEDVPFDELVGMQGPVFHLVENAITVLASNAIFLIVVIFVPFSLGRIVLYYLSWFFSSASTPMLAKMMPFTETAISIANDTLKSALNVVKKFSSDSNNEGVIGHVIEVVTQSLKINATGLSVIQGTGKSSLIKGTTIGSSYLSDLTTLAVGYMFIFCLVFLYIGSLALLRYARGERFTIGRLYGIATILEAIPSLCRQFFAGMKHLMTMVKVAFLLVIELGVFPLMCGWWLDVCTLKMLGTTIAQRVEFFTMSPLASSSIHWLVGIVYMLQISIFVSLLRGVLRNGVLYFLRDPADPNYNPFRDLIDDPVHKHARRVLLSVAVYGSLIVMLVFLPVKLAMRVAPSIFPLDITIFDPFTEIPVDVLLFQICIPFAIEHFKPRATIKSLLHHWFATVGWALGLTDFLLPKPEENGGQENWNGRAERRDRGHGGREMIAPQIEQRMIQHVAAEDNGRGNANEANDVAEEPDVDDQGDSEYGFVLRIVLLLVLAWMTLLIFNAGMVVIPISLGRLVFEAVPRLPITHGIKCNDLFSFSIGCYILWSVAAGTRYAIDYIRSRQLGILVQQICKWCSIVLKSSVLLSIWIFVIPVLIGLLFELLVIVPMRVPIDESPVFLLYQDWALGLIFLKIWTRLVMLDQMAPLVDESWRSKFERVRDDGFSRLRGLWVLHEIIMPIVTKLLTALCVPYVLARGIFPVLGYPLIVNSAVYRFAWLGCLIFSALFFCGKRFHVWFTNLHNSIRMTAI

SEQ ID NO: 6409 - protein, 316 aa, Sorghum bicolor
MSFLFKSSNGGTTEKTMPLEEQQEKINELRKVLGDHSSPAIQDFLSDASLARFLRARNWNVQKASKMMKAAVKWRLAFKPENICWDDISEEAETGKIYRADYKDKHGRTVLVLRPGLENTTSATGQIKYLVYSLEKAIMNLTEDQEKMVWLTDFQSWTLGSTPLKVTRETVNVLQDCYPERLGLAILYNPPRIFESFWKIVKPFLDQETRKKVKFVYSNDKESQKIMAEVFDMEELDSAFGGKNPATFEYNSYAERMQEDDKKMGSLHSSTNSLLESAEKEANGADSDASSEASFYSGTDSPKHEDGEHSIAKKSG

SEQ ID NO: 6410 - protein, 316 aa, Sorghum bicolor
MSFLFKSSNGGTTEKTMPLEEQQEKINELRKVLGDHSSPAIQDFLSDASLARFLRARNWNVQKASKMMKAAVKWRLAFKPENICWDDISEEAETGKIYRADYKDKHGRTVLVLRPGLENTTSATGQIKYLVYSLEKAIMNLTEDQEKMVWLTDFQSWTLGSTPLKVTRETVNVLQDCYPERLGLAILYNPPRIFESFWKIVKPFLDQETRKKVKFVYSNDKESQKIMAEVFDMEELDSAFGGKNPATFEYNSYAERMQEDDKKMGSLHSSTNSLLESAEKEANGADSDASSEASFYSGTDSPKHEDGEHSIAKKSS

SEQ ID NO: 6411 - protein, 315 aa, Panicum virgatum
MSFLFKSSNSGTTEKGLSLEEQQEKINELRKELGEYSSAAIQDFLSDASLSRFLRARNWNVQKASKMMKAAVKWRLAFKPENICWADIAQEAETGKIYRADYKDKQGRTVLVLRPGLENTTSATGQIKYLVYSLEKAIMNLTEDQEKMVWLTDFQCWTLGSTPLKVTRETVNVLQDCYPERLGLAILYNPPRIFESFWKIVKPFLDHETRKKVKFVYSNDKESQKIMAEVFDMEELDSAFGGKNPATFEYNSYAERMQEDDKKMGSLHSSTDSFLESSEKEANGADSDASSEASFYSGTDSPRHDDEHSTPKKNS

SEQ ID NO: 6412 - protein, 239 aa, Sorghum bicolor
MVSIVTEAWALAGCGPASKAAAVPAQELPVQHPPAAAAGKTKKRFVSFRCVSSGGGQDHRREATVVVGRRRGLASCALAALAASFSPLAADRAARALVLEEDDDIELLERVKEDRKKRLQKQGVISSSGTETGYLQDLIYKLSKVGQAIDKDDLPAASSVLGPSSDAKWVQNINMAFSKFSSSPEERNVVDSFNSSLATLFTSVNKLDAESSKSAFVSSATALEKWIALAGLGGQLKGY

SEQ ID NO: 6413 - protein, 233 aa, Setaria italica
MVAIATEAWALAGCGAASKVAATAVQELPAQQHPPAAACRAKFRGVSSNGGQDRREAAVVVGRRSGLASCVLAALAASFSPLAADRPARALVLEEDDDIELLERVKEDRKKRLEKQGIISASGTETGYLQDLIYKLSKVGQAIDKDDLPAASSVLGPSTDAQWVQNINAAFSKFSSSPEERSTVDSFNASLASLFTSVNKLDAESSKSAFVSSATALEKWIALAGLSGQLKGF

SEQ ID NO: 6414 - protein, 558 aa, Unknown
  Sequence found in Organisms: Sorghum bicolor, Saccharum officinarum
MALHAPVLVLKDSLKRESGAKVHQANIQAAKAVADIIRTTLGPRSMLKMLLDAGGGIVVTNDGNAILREIDIAHPAAKSMIELSRTQDEEVGDGTTSVIVLAGEMLHVAQAFIDKNYHPTVICRAYTKALDDAIAVLDKIAMPVDVNDRGAMLGLVKSSIGTKFTGQFGDLIADLAIDATTTAGVDLGQGMREVDIKKYIKVEKVPGGQLEDSRVLKGVMINKDVVAPGKMRRKIVNPRIILLDCPVEYKKGENQTNAELMKEEDWQVLLEMEEEYIKNLCAQILKFKPDLVITEKGLSDLAIHYLSKAGVSAIRRLRKTDNNRIAKACGAVIVNRPEELQESDVGTGAGLFEVKKIGDEFFAFIVDCKDPKACTVLLRGASKDVLNEVERNLQDAMSVARNILKNPKLLPGGGATELTVSATLKQKSSSVEGVEKWPYEAAALAFEAIPRTLAQNCGLNVIRIMTQLQGKHANGENAWVGIDGRSGDIVDMKERKIWDSYSVKAQTFKTAIEAACMLLRIDDIVSGIKKKQAPGASAPKQPQIETEGDADNEQMIPE

SEQ ID NO: 6415 - protein, 558 aa, Zea mays
MALHAPVHVMKDSLKRESGAKVHQANIQAAKAVADIIRTTLGPRSMLKMLLDAGGGIVVTNDGNSILREIDIAHPAAKSMIELSRTQDEEVGDGTTSVIVLAGEMLHVAQAFIDKNYHPTVICRAYTKALDDAIAVLDKIAMPVDVNDRGAMLGLVKSSIGTKFTGQFGDLIADLAIDATTTAGVDLGQGMREVDIKKYIKVEKVPGGQLEDSRVLKGVMINKDVVAPGKMRRKIVNPRIILLDCPVEYKKGENQTNAELMKEEDWQVLLEMEEEYIKNLCAQILKFKPDLVITEKGLSDLAIHYLSKAGVTAIRRLRKTDNNRIAKACGAVIVNRPEELQESDVGTGAGLFEVKKIGDEFFAFIVDCKDPKACTVLLRGASKDVLNEVERNLQDAMSVARNILKNPKLLPGGGATELTVSATLKQKSSSVEGVEKWPYEAAALAFEAIPRTLAQNCGLNVIRIMTQLQGKHANGENAWVGIDGRSGDIVDMKERKIWDSYSVKAQTFKTAIEAACMLLRIDDIVSGIKKKQAPGASAPKQPQIETEGDADNEQMIPE

SEQ ID NO: 6416 - protein, 558 aa, Panicum virgatum
MALHAPVLVMKDSMKRESGAKVHQANIQAAKAVADIIRTTLGPRSMLKMLLDAGGGIVVTNDGNAILREIDIAHPAAKSMIELSRTQDEEVGDGTTSVIVLAGEMLHVAQAFIDKNYHPTVICRAYTKALDDAIAVLDKIAMPVDVNDRTAMLGLVKSSIGTKFTGQFGDLIADLAIDATTTAGVDLGQGMREVDIKKYIKVEKVPGGQLEDSTVLKGVMINKDVVAPGKMRRKIVNPRIILLDSPIEYKKGENQTNAELMKEEDWQVLLEMEEEYIKNLCAQILKFKPDLVITEKGLSDLAIHYLSKAGVSAIRRLRKTDNNRIAKACGAVIVNRPEELQESDVGTGAGLFEVKKIGDEFFSFVVDCKDPKACTVLLRGASKDVLNEVERNLQDAMSVARNILKNPKLLPGGGATELTVSATLKQKSSSVEGVEKWPYEAAALAFEAIPRTLAQNCGLNVIRTMTQLQGKHANGENAWVGLDGRSGDIVDMKERKIWDSYSVKAQTFKTAIEAACMLLRIDDIVSGIKKKQAPGASAPKQPQIETEGDADNEQMIPE

SEQ ID NO: 6417 - protein, 558 aa, Setaria italica
MALHAPVLVLKDSLKRESGAKVHQANIQAAKAVADIIRTTLGPRSMLKMLLDAGGGIVVTNDGNAILREIDIAHPAAKSMIELSRTQDEEVGDGTTSVIVLAGEMLHVAQAFIDKNYHPTVICRAYTKALDDAIAVLDKIAMPVDVNDRVSMLGLVKSSIGTKFTGQFGDLIADLAIDATTTAGVDLGQGMREVDIKKYIKVEKVPGGQLEDSRVLKGVMINKDVVAPGKMRRKIVNPRIILLDSPIEYKKGENQTNAELMKEEDWQVLLEMEEEYIKNLCAQILKFKPDLVITEKGLSDLAIHYLSKAGVSAIRRLRKTDNNRIAKACGAVIVNRPEELQESDVGTGAGLFEVKKIGDEFFAFIVDCKDPKACTVLLRGASKDVLNEVERNLQDAMSVARNILKNPKLLPGGGATELTVSAALKQKSSSVEGVEKWPYEAAALAFEAIPRTLAQNCGLNIIRTMTQLQGKHANGENAWVGLDGRSGEIVDMKERKIWDSYSVKAQTFKTAIEAACMLLRIDDIVSGIKKKQAPGASAPKQPQIETEGDADNEQMIPE

SEQ ID NO: 6418 - protein, 558 aa, Oryza sativa
MALNAPVLVLKDSLKRESGTKVHHANIQAAKAVADIIRTTLGPRSMLKMLLDASGGIVVTNDGNAILREIDIAHPAAKSMIELSRTQDEEVGDGTTSVIVLAGEMLHVAEAFIDKHYHPTVICRAYTKALEDALAVLDKIAMHVDVNDRAAMLGLVKSSIGTKFTGQFGDLIADLAIDATTTAGVDLGQGMREVDIKKYIKVEKVPGGQLEDSRVLKGVMFNKDVVAPGKMRRKIVNPRIILLDCPVEYKKGENQTNAELMKEEDWQVLLEMEEEYIKNLCAQILKFKPDLVVTEKGLSDLAIHYLSKAGVSAIRRLRKTDNNRIAKACGAVIVNRPEELQESDVGTRAGLFEVKKIGDEFFTFIVDCKDPKACTVLLRGASKDVLNEVERNLQDAMSVARNILKNPKLLPGGGATELTVSAALKQKSSSVEGVEKWPYEAAALAFEAIPRTLAQNCGLNVIRIMTQLQGKHANGENAWVGIDGRSGDIVDMKERKIWDSYSVKAQTFKTAIEAACMLLRIDDIVSGIKKKQAPGASAPKQPQIEQEGDADNEQMIPE

SEQ ID NO: 6419 - protein, 95 aa, Setaria italica
MALHAPVLVLKDSLKRESGAKVHQANIQAAKAVADIIRTTLGPRSMLKMLLDAGGGIVVTNDGNAILREIDIAHPAAKSMIELSRTQDEEMAQPL

SEQ ID NO: 6420 - protein, 558 aa, Brachypodium distachyon
MALHAPVLVLKDSLKRESGAKVHHANIQAAKAVADIIRTTLGPRSMLKMLLDASGGIVVTNDGNAILREIDIAHPAAKSMIELSRTQDEEVGDGTTSVIVLAGEMLHVAEAFIEKNYHPTVICRAYTKALEDALAVLDKIAMPVDVNDRGAMLGLVKSSIGTKFTGQFGDLIADLAIDATTTAGVDLGQGMREVDIKKYIKVEKIPGGQLEDSRVLKGVMFNKDVVAPGKMKRKIVNPRIILLDCPVEYKKGENQTNAELMKEEDWQVLLELEEEYIKNLCAQILKFKPDLVVTEKGLSDLAIHYLSKAGVSAIRRLRKTDNNRIAKACGAVIVNRPEELQESDVGTRAGLFEVKKIGDEFFSFIVDCKDPKACTVLLRGASKDVLNEVERNLQDAMSVARNILKNPKLLPGGGGTELTVSATLKQKSSSVEGVEKWPYEAAALAFEAIPRTLLQNCGLNVIRTMTQLQGKHANGENAWVGIDGRSGDIVDMKERKIWDSYSVKAQTFKTAIEAACMLLRIDDIVSGIKKKQAPGAGAPKQPQIEQEGDADTEQMIPE

SEQ ID NO: 6421 - protein, 417 aa, Brachypodium distachyon
MPVDVNDRGAMLGLVKSSIGTKFTGQFGDLIADLAIDATTTAGVDLGQGMCEVDIKKYIKVEKIPGGQLEDSRVLKGVMFNKDVVAPGKMKRKIVNPRIILLDCPVEYKKGENQTNAELMKEEDWQVLLELEEEYIKNLCAQILKFKPDLVVTEKGLSDLAIHYLSKAGVSAIRRLRKTDNNRIAKACGAVIVNRPEELQESDVGTRAGLFEVKKIGDEFFSFIVDCKDPKACTVLLRGASKDVLNEVERNLQDAMSVARNILKNPKLLPGGGGTELTVSATLKQKSSSVEGVEKWPYEAAALAFEAIPRTLLQNCGLNVIRTMTQLQGKHANGENAWVGIDGSCGDIVDMKERKIWVSYSVKAQTFKTAIEAACMLLRIDDIVSGIKKKQAPGAGAPKQPQIEQEGDADTEQMFPE

SEQ ID NO: 6422 - protein, 558 aa, Avena sativa
MALHAPVLVLKDSLKRESGAKVHHANIQAAKAVADIIRTTLGPRSMLKMLLDASGGIVVTNDGNAILREIDIAHPAAKSMIELSRTQDEEVGDGTTSVIVLAGEMLHVAETFIEKNYHPTVICRAYTRALEDALAVLDKIAMPVDVNDRVAMLGLVKSSIGTKFTGQFGDLIADLAIDATTTAGVDLGQGMREVDIKKYIKVEKIPGGQLEDSKVLKGVMFNKDVVAPGKMRRKIVNPRIILLDCPVEYKKGENQTNAELMKEEDWQLLLELEEEYIKNLCAQILKFKPDLVVTEKGLSDLAIHYLSKAGVSAIRRLRKTDNNRIAKACGAVIVNRPEELQESDVGTRAGLFEVKKIGDEFFSFIIDCQDPKACTVLLRGASKDVLNEVERNLQDAMSVARNILKNPKLLPGGGASELTVSATLKQKSSSVEGVEKWPYEAAALAFEAIPRTLLQNCGLNVIRTMTQLQGKHANGENPWVGIDGRTGDIVDMKERKIWDSYSVKAQTFKTAIESACMLLRIDDIVSGIKKKQAPGGGAPKQPQIETEGDADTEQMIPE

SEQ ID NO: 6423 - protein, 558 aa, Avena sativa
MALHAPVLVLKDSLKRESGAKVHHANIQAAKAVADIIRTTLGPRSMLKMLLDASGGIVVTNDGNAILREIDIAHPAAKSMIELSRTQDEEVGDGTTSVIVLAGEMLHVAETFIEKNYHPTVICRAYTRALEDALAVLDKIAMPVDVNDRVAMLGLVKSSIGTKFTGQFGDLIADLAIDATTTAGVDLGQGMREVDIKKYIKVEKIPGGQLEDSKVLKGVMFNKDVVAPGKMRRKIVNPRIILLDCPVEYKKGENQTNAELMKEEDWQLLLELEEEYIKNLCAQILKFKPDLVVTEKGLSDLAIHYLSKAGVSAIRRLRKTDNNRIAKACGAVIVNRPEELQESDVGTRAGLFEVKKIGDEFFSFIIDCQDPKACTVLLRGASKDVLNEVERNLQDAMSVARNILKNPKLLPGGGASELTVSATLKQKSSSVEGVEKWPYEAAALAFEAIPRTLLQNCGLNVIRTMTQLQGKHANGENPWVGIDGRTGDIVDMKERKIWDSYSVKAQTFKTAIESACMLLRIDDIVSGIKKQQAPGGGAPKQPQIETEGDADTEQMIPE

SEQ ID NO: 6424 - protein, 559 aa, Oryza sativa
MALHAPVLVLKDSLKRESGTKVHHANIQAAKAVADIIRTTLGPQSMLKMLLDAAGGIVVTNDGNCILRELDLAHPAAKSMIELSRTQDEEVGDGTTSVIVLAGEMLHVAQAFIDKNYHPTVICRAYTKALDDALSVLDKIAIPVDVDDRVAMLGLVKSSIGTKFTGQFGDLIADLAIDATTTAGVDLGQGIREVDIKKYIKVEKVPGGQLEDSKVLKGVMINKDVVAPGKMRRKIVNPRIILLDCPLEYKKGENQTNAELMKEEDWQVMLQMEEEYIENLCAQILKFKPDLVITEKGLSDLAVHYLGKAGVSAIRRLRKTDNNRIAKACGAVIVNRPEELQESDVGTGAGLFEVKKFGDEFFAFIVDCKDPKACTVLLRGASKDVLNEVERNLQDAMSMARNIWKNPKLLPGGGATELTVSATLKQKSSSVEGVEKWPYEAAALAFEAIPRTLLQNCGLNVIRTMTQLQGKHANGENAWVGIDGSSGDIVDMKERKIWDSYSVKAQTFKTAIEAACMLLRIDDIVSGIKKKQAPGASSAPKQPQIEQEGDADNEQMIPE

SEQ ID NO: 6425 - protein, 558 aa, Triticum aestivum
MALHAPVLVLKDSLKRESGAKVQHGNIQAAKAVSDIIRTTLGPRSMLKMLLDASGGIVVTNDGNAILRELDIAHPAAKSMIELSRTQDEEVGDGTTSVIVLAGEMLHVAETFIEKNYHPTVICRAYSRALEDAIAVLDKIAMPVDVNDREAMLGLVKSSIGTKFTGQFGDLIADLAIDATTTAGVDLGQGMREVDIKKYIKVEKIPGGQLEDSKVLKGVMFNKDVVAPGKMRRKIVNPRIILLDCPVEYKKGENQTNAELMSEEDWKVLLDMEEEYIKNLCVQILKFKPDLVITEKGLSDMAMHYLSKAGVSAIRRLRKTDNNRIAKACGAVIVNRPEELQESDVGTRAGLFEVKKIGDEFFSFIIECKDPKACTVLLRGASKDILNEVERNLQDAMSVARNILKNPKLLPGGGASELTVSATLKQKSSSVEGVEKWPYEAAALAFEAIPRTLLQNCGLNVIRTMTQLQGKHANGENPWVGVDGRTGDIVDMKERKIWDSYSVKAQTFKTAIESACMLLRIDDIVSGIKKKQAPGSGAPKQPQIETGEDADTEQMIPE

SEQ ID NO: 6426 - protein, 558 aa, Triticum aestivum
MALHAPVLVLKDSLKRESGAKVQHGNIQAAKAVSDIIRTTLGPRSMLKMLLDASGGIVVTNDGNAILRELDIAHPAAKSMIELSRTQDEEVGDGTTSVIVLAGEMLHVAETFIEKNYHPTVICRAYSRALEDAIAVLDKIAMPVDVNDREAMLGLVKSSIGTKFTGQFGDLIADLAIDATTTAGVDLGQGMREVDIKKYIKVEKIPGGQLEDSKVLKGVMFNKDVVAPGKMKRKIVNPRIILLDCPVEYKKGENQTNAELMSEEDWKVLLDMEEEYIKNLCVQILKFKPDLVITEKGLSDMAMHYLSKAGVSAIRRLRKTDNNRIAKACGAVIVNRPEELQESDVGTRAGLFEVKKIGDEFFSFIIECKDPKACTVLLRGASKDILNEVERNLQDAMSVARNILKNPKLLPGGGASELTVSATLKQKSSSVEGVEKWPYEAAALAFEAIPRTLLQNCGLNVIRTMTQLQGKHANGENPWVGVDGRTGDIVDMKERKIWDSYSVKAQTFKTAIESACMLLRIDDIVSGIKKKQAPGSGAPKQPQIETGEDADTEQMIPE

SEQ ID NO: 6427 - protein, 558 aa, Secale cereale
MALHAPVLVLKDSLKRESGAKVQHGNIQAAKAVSDIIRTTLGPRSMLKMLLDASGGIVVTNDGNAILRELDIAHPAAKSMIELSRTQDEEVGDGTTSVIVLAGEMLHVAETFIEKNYHPTVICRAYSRALEDAIAVLDKIAMPVDVNDREAMLGLVKSSIGTKFTGQFGDLIADLAIDATTTAGVDLGQGMREVDIKKYIKIEKIPGGQLEDSKVLKGVMFNKDVVAPGKMKRKIVNPRIILLDCPVEYKKGENQTNAELMSEEDWKVLLDMEEEYIKNLCVQILKFKPDLVITEKGLSDMAMHYLSKAGVSAIRRLRKTDNNRIAKACGAVIVNRPEELQESDVGTRAGLFEVKKIGDEFFSFIIECKDPKACTVLLRGASKDILNEVERNLQDAMSVARNILKNPKLLPGGGASELTVSATLKQKSSSVEGVEKWPYEAAALAFEAIPRTLLQNCGLNVIRTMTQLQGKHANGENPWVGVDGRTGDIVDMKERKIWDSYSVKAQTFKTAIESACMLLRIDDIVSGIKKKQAPGSGAPKQPQIETGEDADTEQMIPE

SEQ ID NO: 6428 - protein, 558 aa, Secale cereale
MALHAPVLVLKDSLKRESGAKVQHGNIQAAKAVSDIIRTTLGPRSMLKMLLDASGGIVVTNDGNAILRELDIAHPAAKSMIELSRTQDEEVGDGTTSVIVLAGEMLHVAETFIEKNYHPTVICRAYSRALEDAIAVLDKIAMPVDVNDREAMLGLVKSSIGTKFTGQFGDLIADLAIDATTTAGVDLGQGMREVDIKKYIKIEKIPGGQLEDSKVLKGVMFNKDVVAPGKMKRKIVNPRIILLDCPVEYKKGENQTNAELMSEEDWKVLLDMEEEYIKNLCVQILKFKPDLVITEKGLSDMAMHYLSKAGVSAIRRLRKTDNNRIAKACGAVIVNRPEELQESDVGTRAGLFEVKKIGDEFFSFIIECKDPKACTVLLRGASKDILNEVERNLQDAMSVARNILKNPKLLPGGGASELTVSATLKQKSSSVEGVEKWPYEAAALAFEAIPRTLLQNCGLNVIRTMTQLQGKHANGENPWVGVDGRTGDIVDMKERKIWDSYSVKAQTVKTAIESACMLLRIDDIVSGIKKKQAPGSGAPKQPQIETGEDADTEQMIPE

SEQ ID NO: 6429 - protein, 489 aa, Elaeis guineensis
MHAPVLVLKDSLKRESGSKVHHANIQASKAVADIIRTTLGPRSMLKMLLDAGGGIVVTNDGNAILRELDLAHPAAKSMIELSRTQDEEVGDGTTSVIVLAGEMLHVAEAFIEKNYHPTVICRAYNKALEDAISVIDKIAMTIDVNDRATMLGLVKSCIGTKFTGQFGDLIADLAIDSTTTVGVDLGQGMREVDIKKYIKVEKVPGGQLEDSKVLKGVMINKDVVAPGKMRRKILNPRIILLDCPLEYKKGENQTNAELVKEEDWEVLLKMEEEYIENLCMQILKFKPDLVITEKGLSDLACHYLSKAGVSAIRRLRKTDNNRIAKACGAVIVNRPEELQESDVGTGAGLFEVKKFGDEFFAFIVDCKDPKACTVLLRGASKDLLNEVERNLQDAMSVARNILKNPKLLPGGGATELTVSAALKQKSSSIEGIEKWPYEAAAVAFEAIPRTLAQNCGVNVIRTMTALQGSMLMKKMHGLALMETLVLLLI

SEQ ID NO: 6430 - protein, 557 aa, Elaeis guineensis
MHAPVLVLKDSLKRESGSKVHHANIQASKAVADIIRTTLGPRSMLKMLLDAGGGIVVTNDGNAILRELDLAHPAAKSMIELSRTQDEEVGDGTTSVIVLAGEMLHVAEAFIEKNYHPTVICRAYNKALEDAIAVLDKIAMPIEVNDRATMLGLVKSCIGTKFTGQFGDLIADLAIDATTTVGVDLGQGLREVDIKKYIKVEKVPGGQLEDSKVLKGVMINKDVVAPGKMRRKILNPRIILLDCPLEYKKGENQTNAELVKEEDWEVLLKMEEEYIENLCMQILKFKPDLVITEKGLSDLACHYLSKAGVSAIRRLRKTDNNRIAKACGAVIVNRPEELQESDVGTGAGLFEVKKIGDEFFAFIVDCRDPKACTVLLRGASKDLLNEVERNLQDAMSVARNILKNPKLLPGGGATELTVSAALKQKSSLIEGIEKWPYEAAAVAFEAIPRTLAQNCGVNVIRTMTALQGKHANEENAWVGIDGNTGAIVDMKERKIWDSYNVKAQTFKTAIEAACMILRIDDIVSGIKKKQAPGAGPTPSRPKMEEEGDADNEQMLPE

SEQ ID NO: 6431 - protein, 554 aa, Ricinus communis
MQAPVLVLKDSLKRESGTKVHHANIQASKAVADIIRTTLGPRSMLKMLLDAAGGIVVTNDGNAILRELDLAHPAAKSMIELSRTQDEEVGDGTTSVIVLAGEMLHVAEAFIDKSYHPTVICRAYIKALEDAIAVLDKIAMSIDVNDRATLLGLVKSCIGTKFTSQFGDLIADLAIDATTTVGVDLGQGLRVDIKKYIKVEKVPGGQLEDSKVLKGVMFNKDVVAPGKMRRKIVNPRIILLDCPLEYKKGENQTNAELVKEEDWAVLLKMEEEYIQNMCMQILTFKPDLVITEKGLSDLACHYLSRAGVGAIRRLRKTDNNRIAKACGAVIVNRPEELQESDVGTGAGLFEVKKIGDEFFSFIVDCKDPKACTVLLRGASKDLLNEVERNLQDAMSVARNILKNPKLLPGGGATELTVSATLKQKSSSVEGIEKWPYEAAALAFEAIPRTLAQNCGVNVIRTMTALQGKHANGDNAWVGIDGNTGEITDMKERKIWDAYNVKAQTFKTAIEAACMLLRIDDIVSGIKKKQAPGAGPSKPKIETEADADGEQILPD

SEQ ID NO: 6432 - protein, 555 aa, Citrullus lanatus
MHAPVLVLKDSLKRESGSKVHHANIQASKAVADIIRTTLGPRSMLKMLLDAQGGIVVTNDGNAILRELDIAHPAAKSMIELSRTQDEEVGDGTTSVIVLAGEMLHVAEAFIEKNYHPTVICRAYSKALEDALAVLDKIAMDIDVKDRTAMLGLVKSCIGTKFTSQFGDLIADLAIDATTIVGVDLGQGLREVDIKKYIKVEKVPGGQLEDSRVLKGVMFNKDVVAPGKMRRKIVNPRIILLDCPLEYKKGENQTNAELVKEEDWGILLKMEEEYIENICAQIIKFKPDLVITEKGLSDLACHYLSKAGISAIRRLRKTDNNRIAKACGAVIVNRPDELQESDVGTGAGLFEVKKIGDEFFAFIVDCKEPKACTVLLRGASKDLLNEVERNLQDAMSVARNIIKNPKLVPGGGATELTVSATLKQKSSSVEGIEKWPYEAAALAFEAIPRTLAQNCGVNVIRTMTALQGKHANGENAWTGIDGNTGEITDMKERKIWDVYNVKAQTFKTAIEASCMLLRIDDIVSGIKKKQAPGAGPSKPQIETEADADNEQILPE

SEQ ID NO: 6433 - protein, 557 aa, Manihot esculenta
MNAPVLVLKDSLKRESGTKVHHANIQASKAVADIIRTTLGPRSMLKMLLDAGGGIVVTNDGNAILRELDLAHPAAKSMIELSRTQDEEVGDGTTSVIVLAGEMLHVAEAFIDKNYHPTVICRAYNKALEDAVAVLDKIAMSIDVNDRAMMLGLVKSCIGTKFTSQFGDLIADLAIDATSTVGIDLGQGLREVDIKKYIKVEKVPGGQLEDSKVLKGVMFNKDVVAPGKMRRKIVNPRIILLDCPLEYKKGENQTNAELVKEEDWGVLLKMEEEYIESMCMQILKFKPDLVITEKGLSDLACHYLSKAGVSAIRRLRKTDNNRIAKACGAVIVNRPDELQESDVGTGAGLFEVKKIGDEFFSFIVDCKDPKACTVLLRGASKDLLNEVERNLQDAMSVARNILKNPKLVPGGGATELTVSATLKQKSSAIEGIEKWPYEAAAIAFEAIPRTLAQNCGVNVIRTMTALQGKHANGENAWVGIDGNTGEITDMKERKIWDAYNVKAQTFKTAIEAACMLLRIDDIVSGIKKKQAPGAGQAPSKPQIETEGDADGEQILPD

SEQ ID NO: 6434 - protein, 556 aa, Tripterygium wilfordii
MHAPVLVLKDSLKRESGSKVQHANIQASKAVADIIRTTLGPRSMLKMLLDAAGGIVVTNDGNAILRELDLAHPAAKSMIELSRTQDEEVGDGTTSVIVLAGEMLHVAEAFIDKNYHPTVICRAYNKALEDAIAVLDRIAMSIDVNDRATMLGLVKSCIGTKFTSQFGDLIADLAIDATTTVGVDLGQGMREVDIKKYIKVEKVPGGQLEDSRVLKGVMFNKDVVAPGKMRRKIVNPRIILLDCPLEYKKGENQTNAELVKEEDWGILLKMEEEYIENLCIQILKFKPDLVITEKGLSDLACHYLSKAGVSAIRRLRKTDNNRIAKACGAVIVNRPEELQESDVGTGAGLFEVKKIGDEFFAFIVDCVDPKACTILLRGASKDLLNEVERNLQDAMSVARNILKNPKLLPGGGGTELTVSATLKQKSSSIEGIEKWPYEAAAIAFEAIPRTLAQNCGVNVIRTMTALQGQHANGENAWIGIDGNTGLIADMQERKIWDSYNVKAQTFKTAIEAACMILRIDDIVSGIKKKQAPGAGQAPKPKVETEADADGEQILPD

SEQ ID NO: 6435 - protein, 557 aa, Citrus sinensis
MHSPVLVLKDSLKRESGTKVHHANIQASKAVADIIRTTLGPRSMLKMLLDASGGIVVTNDGNAILRELDVAHPAAKSMIELSRTQDEEVGDGTTSVIVLAGEMLHVAEEFIDKNYHPTVICRAYNKALEDAVAVLDKIAMPIDTNDRATMLGLVKSCIGTKFTSQFGDLIADLAIDATTTVGVDLGQGLREVDIKKYIKVEKVPGGQLEDSRVLKGVMFNKDVVAPGKMRRKIVNPRIILLDSPLEYKKGENQTNAELVKEEDWEVLLKMEEEYIENLCMQILKFKPDLVITEKGLSDLACHYLSKAGVSAIRRLRKTDNNRIAKACGAVIVNRPDELQESDVGTGAGLFEVKKIGDEFFAFIVDCKDPKACTVLLRGASKDLLNEVERNLQDAMSVARNIIKNPKLVPGGGATELTVSATLKQKSSSIEGIEKWPYEAAAIAFEAIPRTLAQNCGVNVIRTMTALQGKHANGENAWIGIDGNTGAISDMKERKIWDAYNVKAQTFKTAIEAACMLLRIDDIVSGIKKKQAPGSGQTPSKPQIETEADADSEQILPD

SEQ ID NO: 6436 - protein, 557 aa, Unknown
  Sequence found in Organisms: Citrus clementina, Citrus sinensis
MHSPVLVLKDSLKRESGTKVHHANIQASKAVADIIRTTLGPRSMLKMLLDASGGIVVTNDGNAILRELDVAHPAAKSMIELSRTQDEEVGDGTTSVIVLAGEMLHVAEEFIDKNYHPTVICRAYNKALEDAVAVLDKIAMPIDTNDRATMLGLVKSCIGTKFTSQFGDLIADLAIDATTTVGVDLGQGLREVDIKKYIKVEKVPGGQLEDSRVLKGVMFNKDVVAPGKMRRKIVNPRIILLDSPLEYKKGENQTNAELVKEEDWEVLLKMEEEYIENLCMQILKFKPDLVITEKGLSDLACHYLSKAGVSAIRRLRKTDNNRIAKACGAVIVNRPDELQESDVGTGAGLFEVKKIGDEFFAFIVDCKDPKACTVLLRGASKDLLNEVERNLQDAMSVARNIIKNPKLVPGGGATELTVSATLKQKSSSIEGIEKWPYEAAAIAFEAIPRTLAQNCGINVIRTMTALQGKHANGENAWIGIDGNTGAISDMKERKIWDAYNVKAQTFKTAIEAACMLLRIDDIVSGIKKKQAPGSGQTPSKPQIETEADADSEQILPD

SEQ ID NO: 6437 - protein, 127 aa, Cucumis melo
MHAPVLVLKDSLKRESGSKVHHANIQASKAVADIIRTTLGPRSMLKMLLDAQGGIVVTNDGNAILRELDIAHPAAKSMIELSRTQDEEVGDGTTSVIVLAGEMLHVAEAFIEKNYHPTVICRAYNKL

SEQ ID NO: 6438 - protein, 556 aa, Euonymus alatus
MHAPVLVLKDSLKRESGSKVQHANIQASKAVADIIRTTLGPRSMLKMLLDAAGGIVVTNDGNAILRELDLAHPAAKSMIELSRTQDEEVGDGTTSVIVLAGEMLHVAEAFIDKNYHPTVICRAYNKALEDAIAVLDRIAMSIDVNDRAMMLGMVKSCIGTKFTSQFGDLIADLAIDATTTIGVDLGQGMREVDIKKYIKVEKVPGGQLEDSRVLKGVMFNKDVVAPGKMRRKIVNPRIILLDCPLEYKKGENQTNAELVKEEDWGVLLKMEEEYIENLCVQILKFKPDLVITEKGLSDLACHYLSKAGVSAIRRLRKTDNNRIAKACGAVIVNRPEELQESDVGTGAGLFEVKKIGDEFFAFIVDCKDPKACTILLRGASKDLLNEVERNLQDAMSVARNILKNPKLVPGGGGTELTVSATLKQKSSSIEGIEKWPYEAAAIAFESIPRTLAQNCGVNVIRTMTALQGQHANGENAWIGIDGNTGLIADMHERQIWDAYNVKAQTFKTAIEAACMILRIDDIVSGIKKKQAPGAGQAPKPKVETEADADGEQILPD

SEQ ID NO: 6439 - protein, 555 aa, Euphorbia peplus
MHAPVLVLKDSLKRESGTKVHHANIQASKAVADIIRTTLGPRSMLKMLLDASGGIVVTNDGNAILRELDVAHPAAKSMIELSRTQDEEVGDGTTSVIILAGEMLHVAEAFIDKSYHPTVICRAYNKALEDAIAVLDKIAMTIDVNDRATMLGLVKSCIGTKFTSQFGDLIADLAIDATSTVGVDLGQGLREVDIKKYIKVEKVPGGQLEDSKVLKGVMFNKDVVAPGKMRRKIVNPRIILLDSPLEYKKGENQTNAELVKEEDWAVLLKMEEEYIQNLCMQILKFKPDLVITEKGLSDLACHYFSKAGVSAIRRLRKTDNNRIAKACGAVIVNRPDELQESDVGTGAGLFEVKKIGDEFFSFIVDCKEPKACTVLLRGASKDLLNEVERNLQDAMSVARNILKNPKLVPGGGATELTVSATLKQKSSSIEGIEKWPYEAAAIAFEAIPRTLAQNCGVNVIRTMTSLQGKHANGDNAWTGIDGNTGEICDMKERKIWDAYNVKAQTFKTAIEAASMLLRIDDIVSGIKKKQAPGAGPSKPTVETEADADGEQILPD

SEQ ID NO: 6440 - protein, 557 aa, Gossypium hirsutum
MHAPVLVLKDSLKRESGTKVHHANIQASKAVADIIRTTLGPRSMLKMLLDASGGIVVTNDGNAILRELDLAHPAAKSMIELSRTQDEEVGDGTTSVIVLAGEMLHVAEAFIEKNYHPTVICRAYNKALEDAIAVLDKIAMSIDVKDRATMLGLVKSCIGTKFTSQFGDLIADLAIDATQTVGVDLGQGLREVDIKKYIKVEKVPGGQLEDSKVLKGVMINKDVVAPGKMKRKIVNPRIILLDCPLEYKKGENQTNAELVKEEDWEVLLKMEEEYIESLCLQILKFKPDLVVTEKGLSDLACHYLSKAGVSAIRRVRKTDNNRIAKASGAVIVNRPDELQESDVGTGAGLFEVKKIGDEFFAFIVDCKDPKACTVLLRGASKDLLNEVERNLQDAMSVARNIIKNPKLVPGGGATELTVSATLKQKSSSVEGIEKWPYEAAALAFEAIPRTLAQNCGVNVIRTMTALQGKHANGENAWIGIDGNTGAIADMKERKIWDAYNVKAQTFKTAIEAACMLLRIDDIVSGIKKKQAPGAGQGPTKPKVETEADADGEQILPD

SEQ ID NO: 6441 - protein, 556 aa, Euonymus alatus
MHAPVLVLKDSLKRESGSKVQHANIQASKAVADIIRTTLGPRSMLKMLLDAAGGIVVTNDGNAILRELDLAHPAAKSMIELSRTQDEEVGDGTTSVIVLAGEMLHVAEAFIDKNYHPTVICRAYNKALEDAIAVLDKIAMSIDVNDRATMLGLVKSCIGTKFTSQFGDLIADLAIDATTTVGVDLGQGIREVDIKKYIKVEKVPGGQLEDSRVLKGVMFNKDVVAPGKMRRKIVNPRIILLDCPLEYKKGENQTNAELVNEEDWGVLLKMEEEYIENLCVQILKFKPDLVITEKGLSDLACHYLSKAGVSAIRRLRKTDNNRIAKACGAVIVNRPEELQESDVGTGAGLFEVKKIGDEFFAFIVDCIDPKACTILLRGASKDLLNEVERNLQDAMSVARNILKNPKLVPGGGGTELTVSATLKQKSSSIEGIEKWPYEAAAIAFEAIPRTLAQNCGVNVIRTMTALQGQHANGENAWIGIDGNTGLVADMQERQIWDAYNVKAQTFKTAIEAACMLLRIDDIVSGIKKKQAPGAGQAPKSKVETEADADGEQILPD

SEQ ID NO: 6442 - protein, 557 aa, Vitis vinifera
MQAPVLVLKDSLTRESGSKVQHANIQASKAVADIIRTTLGPRSMLKMLLDAGGGIVVTNDGNSILRELDLAHPAAKSMIELSRTQDEEVGDGTTSVIVLAGEMLHVAEAFIDKNFHPTVICRAYNKALEDAIAVLDKIAAPVDVNDRVAMLGMVKSCIGTKFTGQFGDLIADLALDATTTVGVDLGQGLREVDIKKYIKVEKVPGGQLEDSKVLKGVMINKDVVAPGKMRRKIINPRIILLDCPLEYKKGENQTNAELVREEDWGILLKMEEEYIENLCMQILKFKPDLVITEKGLSDLACHYLSKAGVSAIRRLRKTDNNRIAKACGAVVVNRPDELQESDVGTRAGIFEVKKIGDEFFAFIDECTDPKACTVLLRGASKDLLNEVERNLQDAMSVARNMIKNPKLVPGGGATELTVSATLKQKSSSVEGIEKWPYEAAAIAFEAIPRTLAQNCGVNVIRTMTALQGKHANGENAWIGIDGSTGAITDMKERKIWDAYNVKAQTFKTAIEAACMLLRIDDIVSGIKKKQAPGAGQAPSKPTIEQEGDADNEQMIPE

SEQ ID NO: 6443 - protein, 513 aa, Pennisetum glaucum
MLKMLLDAGGGIVVTNDGNAILREIDVAHPAAKSMIELSRTQDEEVGDGTTSVIVLAGEMLHVAQAFIDKNYHPTVICRAYTKALDDAIAVLDKIAMPVDVNDRASMLGLVKSSIGTKFTGQFGDLIADLAIDATTTAGVDLGQGMREVDIKKYIKVEKVPGGQLEDSRVLKGVMINKDVVAPGKMRRKIINPRIILLDSPIEYKKGENQTNAELMKEEDWQVLLEMEEEYIKDLCAQILKFKPDLVITEKGLSDLAIHYLSKAGVSAIRRLRKTDNNRIARACGAVIVNRPEELQESDVGTGAGLFEVKKIGDEFFAFIVDCKDPKACTVLLRGASKDVLNEVERNLQDAMYVARNILKNPKLLPGGGATELTVSATLKQNSSSVEGVEKWPYEAAALAFEAIPRTLAQNCGLNVIRTMTQLQGKHANGENAWVGLDGRSGDIVDMKERKIWDSYSVKAQTFKTAIEAACMLLRIDDIVSGIKKKQAPGASAPKQPQIETEGDVDNEQMIPE

SEQ ID NO: 6444 - protein, 557 aa, Eucalyptus grandis
MLHSPMLVLKDSLKRESGSKVQHANIQASKAVADIIRTTLGPRSMLKMLLDASGGIVVTNDGNAILRELDIAHPAAKSMIELSRTQDEEVGDGTTSVIVLAGEMLHVAEAFIDKNYHPTVICRAYNKALEDAIAVLDKIAISVDVNDRASMLGLVKSSIGTKFTSQFGDLIADLAIEATTIVGVDLGQGLREVDIKKYIKVEKVPGGQLEDSMVLKGVMFQKDVVAPGKMRRKIVNPRVILLDCPLEYKKGENQTNAELVKEEDWSILLRMEEEYVENICMQILKFKPDLVITEKGLSDLACHYFSKAGVSAIRRLRKTDNNRIAKACGATIVNRPDELQESDVGTGAGLFEVKKIGDEFFAFIVDCKDPKACTVLLRGASKDLLNEVERNLQDAMSVARNIIKNPKLLPGGGATELTVSAMLKQKSSSIEGIEKWPYEAAAIAFEAIPRTLAQNCGVNVIRIMTALQGKHANGENAWIGIDGNTGAITDMKEQKIWDSYNVKAQTFKTAIEASCMLLRIDDIVSGIKKKQAPGAGAAPKPQVETEADADGEQILPD

SEQ ID NO: 6445 - protein, 557 aa, Vitis vinifera
MQAPVLVLKDSLKRESGSKVQHANIQASKAVADIIRTTLGPRSMLKMLLDAGGGIVVTNDGNAILRELDLAHPAAKSMIELSRTQDEEVGDGTTSVIVLAGEMLHVAEAFIDKSYHPTVICRAYNKALEDAIAVLDKIAMSIDVKDRSTVLGLVKSCIGTKFTSQFGDLIADLAIDATMTVGVDLGQGLREVDIKKYIKVEKVPGGQLEDSKVLKGVMINKDVIAPGKMRRKIVNPRIILLDCPLEYKKGENQTNAELVKEEDWGVLLKMEEEYIESICMQILKFKPDLVITEKGLSDLACHYLSKAGVSAIRRLRKTDNNRIAKACGAVIVNRPDELQESDVGTGAGLFEVKKIGDEFFAFIVDCKDPKACTVLLRGPSKDLLNEVERNLQDAMCVARNIIKNPKLVPGGGATELTVSATLKQKSSSIEGIEKWPYEAAAVAFEAIPRTLAQNCGVNVIRTMTALQGKHANGENAWMGIDGNTGAITDMKERKIWDAYNVKAQTFKTAIEAACMLLRIDDIVSGIKKKQAPGAGQAPSKPKIEEEGDADNEQILPE

SEQ ID NO: 6446 - protein, 366 aa, Ambrosia trifida
MQSPVLVLKDSLTRESGSKVHHANIQASKAVADIIRTTLGPRSMLKMMLDASGGIVVTNDGNAILRELDIAHPAAKSMIELSRTQDEEVGDGTTSVIVLAGEMLHVAEAFIDKKYHPTVICRAYNKALEDALAVLDKISMSIDVNDRSMMLGLVKSCIGTKFTSQFGDLIADLALDATTTVGVDLGQGLREVDIKKYIKVEKIPGGQLEDSKVLKGVMFNKDVVVPGKMKRKIVNPRIILLDCPLEYKKGENQTNAELVREEDWAVLLKMEEEYIENLCAQILKFKPDLVITEKGLSDLACHYFSKAGVSAIRRLRKTDNNRIAKACGAVIVNRPDELQESDVGTGAGLFEVKKIGDEFFVLHCGM

SEQ ID NO: 6447 - protein, 556 aa, Catharanthus roseus
MQAPVLVLKDSLKRESGNKVHYGNIQASKAVADIIRTTLGPRSMLKMLLDAAGGIVVTNDGNAILRELDLAHPAAKSMIELSRTQDEEVGDGTTSVIVLAGEMLHVAEAFIGRNYHPTVICRAYNKALEDAIAVLDKIAMSIDVKDRSTMLSLVKSCIGTKFTSQFGDLIADLAIDATSTVGVELGQGLREVDIKKYIKVEKVPGGQLEDSKVLKGVMINKDVVAPGKMRRKIVNPRIILLDCPLEYKKGENQTNAELMREEDWSVLLKMEEEYIENLCFQILKFKPDLVITEKGLSDLACHYLSKAGVSAIRRLRKTDNNRIAKACGAVIVNRPDELQESDVGTGASLFEVRKIGDEFFSFIVECKDPKACTVLLRGASKDLLNEVERNLQDAMSVARNIIKNPKLVPGGGATELTVSAMLKQKSSSIEGIEKWPYEAAAIAFEAIPRTLAQNCGVNVIRTMTALQGKHANGENAWIGIDGNTGEITDMKERKIWDSYTVKAQAFKTAIEAACMLLRIDDIVSGIKKKQAPGAGSAPKSKVEGEGEADNEALIPE

SEQ ID NO: 6448 - protein, 557 aa, Tabernaemontana elegans
MQAPVLVLKDSLKRESGNKVHYGNIQASKAVADIIRTTLGPRSMLKMLLDATGGIVVTNDGNAILRELDLAHPAAKSMIELSRTQDEEVGDGTTSVIVLAGEMLHVAEAFIGRNYHPTVICRAYNKALEDAIAVLDKIAMSIDVNDHATMLGLVKSCIGTKFTSQFGDLIADLAIDATSTVGVELGQGLREVDIKKYIKVEKVPGGQLEDSKVLKGVMINKDVVAPGKMRRKIVNPRIILLDCPLEYKKGENQTNAELMREEDWSVLLKMEEEYIENLCMQILKFKPDLVITEKGLSDLACHYLSKAGVSAIRRLRKTDNNRIAKACGAVIVNRPDELQESDVGSGAGLFEVRKIGDEFFSFIVDCKDPKACTVLLRGASKDLLNEVERNLQDAMSVARNIIKNPKLVPGGGATELTVSAMLKQKSSSIEGIEKWPYEAAAIAFEAIPRTLAQNCGVNVIRTMTALQGKHANGENAWIGIDGNTGEITDTKERKIWDSYTVKAQAFKTAIEAACMLLRIDDIVSGIKKQQAPGAGSAPSKPKVEEEGEADNEALIPE

SEQ ID NO: 6449 - protein, 556 aa, Populus trichocarpa
MHAPVLVLRDSLKRESGTKVHHANIQAAKAVADIIRTTLGPRSMLKMLLDASGGIVVTNDGNAILRELDLAHPAAKSMIELSRTQDEEVGDGTTSVIVLGGEMLHVAEAFIEKSYHPTVICRAYSKALEDAIAVLDKIAVSIDVNDRPAMLGLVKSCIGTKFTSQFGDLIADLAIDATSTVGVDLGQGLREVDIKKYIKVEKVPGSQLEDSKVLKGVMFNKDVVAPGKMKRKIPNPRIILLDCPVEYKKGENQTNAELVREEDWEVLLKMEEEYIENMCVQILKFKPDLVITEKGLSDLACHYLSKAGVSAIRRLRKTDNNRIAKACGATIVNRPDELQESDVGTGAGLFEVKKIGDEFFAFIVDCKDPKACTVLLRGASKDLLNEVERNLQDAMAVARNILKNPKLLPGGGATELTVSAALKQKSSSIEGIEKWPYEAAAIAFEAIPRTLAQNCGVNVIRTMTALQGKHANGENAWIGIDGNTGEITDMKERKIWDAYNVKAQTFKTAIESACMLLRIDDIVSGIKKKQAPGAQGPSKPKIETEADADSEQILPD

SEQ ID NO: 6450 - protein, 499 aa, Eucalyptus grandis
MTEMLFFVNLILHTLLQRHSMIELSRTQDEEVGDGTTSVIVLAGEMLHVAEAFIDKNYHPTVICRAYNKALEDAIAVLDKIAISVDVNDRASMLGLVKSSIGTKFTSQFGDLIADLAIEATTIVGVDLGQGLREVDIKKYIKVEKVPGGQLEDSMVLKGVMFQKDVVAPGKMRRKIVNPRVILLDCPLEYKKGENQTNAELVKEEDWSILLRMEEEYVENICMQILKFKPDLVITEKGLSDLACHYFSKAGVSAIRRLRKTDNNRIAKACGATIVNRPDELQESDVGTGAGLFEVKKIGDEFFAFIVDCKDPKACTVLLRGASKDLLNEVERNLQDAMSVARNIIKNPKLLPGGGATELTVSAMLKQKSSSIEGIEKWPYEAAAIAFEAIPRTLAQNCGVNVIRIMTALQGKHANGENAWIGIDGNTGAITDMKEQKIWDSYNVKAQTFKTAIEASCMLLRIDDIVSGIKKKQAPGAGAAPKPQVETEADADGEQILPD

SEQ ID NO: 6451 - protein, 218 aa, Ambrosia trifida
MQSPVLVLKDSLTRESGSKVHHANIQASKAVADIIRTTLGPRSMLKMLLDASGGIVVTNDGNAILRELDIAHPAAKSMIELSRTQDEEVGDGTTSVIVLAGEMLHVAEAFIDKKYHPTVICRAYNKALEDALAVLDKISMSIDVNDRSMMLGLVKSCIGTKFTSQFGDLIADLALDATTTVGVDLGQGLREVDIKNILRLKNPWRPVGRFQSPQGCYV

SEQ ID NO: 6452 - protein, 556 aa, Flaveria ramosissima
MQSPVLVLKDSLTRESGTKVHHANIQASKAVADIIRTTLGPRSMLKMLLDAAGGIVVTNDGNAILRELDIAHPAAKSMIELSRTQDEEVGDGTTSVIVLAGEMLHVAEAFIDKKYHPTVICRAYNKALEDALAVLDKISMSIDVNDRSMMLGLVKSCIGTKFTSQFGDLIADLALDATTTVGVDLGQGIREVDIKKYIKVEKIPGGQLEDSKVLKGVMFNKDVVVPGKMKRKIVNPRIILLDCPLEYKKGENQTNAELVREEDWAVLLKMEEEYIENLCVQILKFKPDLVITEKGLSDLACHYFSKAGVSAIRRLRKTDNNRIAKACGAVIVNRPDELQESDVGTGAGLFEVKKIGDEFFAYIVDCKDPKACTVLLRGASKDLLNEVERNLQDAMSVARNILKHPKLVPGGGATELTVSATLKQKSSSIEGIEKWPYEAAAVAFEAIPRTLAQNCGVNVIRTMTALQGKHANGENAWTGIDGNSGEIADMKELKIWDAYNVKAQTFKTAIEAACMLLRIDDIVSGIKKRQAPGASQPSKPTIETEVDADNEQMIPE

SEQ ID NO: 6453 - protein, 556 aa, Populus trichocarpa
MHAPVLVLRDSLKRESGRKVHHANIQAAKAVADIIRTTLGPRSMLKMLLDASGGIVVTNDGNAILRELDLAHPAAKSMIELSRTQDEEVGDGTTSVIVLGGEMLHVAEAFIEKNYHPTVICRAYSKALEDAIAVIDKIAMSIDVNDRPTMLGLVKSCIGTKFTSQFGDLIADLAIDATSIVGVDLGQGLREVDIKKYIKVEKVPGGQLEDSKVLKGVMFNKDVVAPGKMKRKIVNPRVILLDCPVEYKKGENQTNAELVREEDWEVLLKMEEEYIENMCAQILKLKPDLVITEKGLSDLACHYLSKAGVSAIRRLRKTDNNRIAKACGATVVNRPDELQESDVGTGAGLFEVKKIGDEFFAFIVDCKDPKACTVLLRGASKDLLNEVERNLQDAMSVARNILKNPKLLPGGGATELTVSAALKQKSSSIEGIEKWPYEAAAIAFEAIPRTLAQNCGVNVIRTMTALQGKHANGENAWIGIDGNTGEITDMKERKIWDAYNVKAQTFKTAIESACMLLRIDDIVSGIKKKQAPGAQGPSKPKIETEADADSEQILPD

SEQ ID NO: 6454 - protein, 556 aa, Helianthus annuus
MQSPVLVLKDSLTRESGSKVHHGNIQASKAVADIIRTTLGPRSMLKMLLDAAGGIVVTNDGNAILRELDVAHPAAKSMIELSRTQDEEVGDGTTSVIVLAGEMLHVAEAFIDKKYHPTVICRAYNKALEDALAVLDKISMSIDVNDRSMMLGLVKSCIGTKFTSQFGDLIADLALDATTTVGVDLGQGLREVDIKKYIKVEKIPGGQLEDSKVLKGVMFNKDVVVPGKMKRKIVNPRIILLDCPLEYKKGENQTNAELVREEDWAVLLKMEEEYIENLCAQILKFKPDLVITEKGLSDLACHYFSKAGVSAIRRLRKTDNNRIAKACGAVIVNRPDELQESDVGTGAGLFEVKKIGDEFFAYIVDCKDPKACTVLLRGASKDLLNEVERNLQDAMSVARNILKHPKLVPGGGATELTVSATLKQKSSSVEGIEKWPYEAAAVAFEAIPRTLAQNCGVNVIRTMTALQGKHANGENAWTGIDGNSGEIADMKELKIWDAYNVKAQTFKTAIEAACMLLRIDDIVSGIKKRQAPGASQPSKPTIETEGDADNEQMIPE

SEQ ID NO: 6455 - protein, 329 aa, Triphysaria pusilla
MNSQVLVLKDNLKRESGSKVQHANIQASKAVADIIRTTLGPRSMLKMMLDPVGGIVVTNDGNAILRELDVAHPAAKSMIELSRTQDEEVGDGTTSVIVLAGEMLHVAEAFIDKNYHPTVICRAYNKALEDAVAALDKIAMTVDVKDRAIMLGLVKSCIGTKFTSQFGDLIADLAIEATTTAGVDLGQGLREVDIKKYIKVEKVPGSQLEDSKVLKGVMFNKDVVAPGKMRRKIVNPRIILLDCPLEYKKGENQTNAELLKEEDWSVLLKMEEEYIENLCVEILKFKPDLVITEKGLSDLACHYFSKAGVSAIRRLRKTDNNRIAKACGA

SEQ ID NO: 6456 - protein, 556 aa, Cichorium intybus
MQSPVLVLKDSLTRESGSKVHHANIQASKAVADIIRTTLGPRSMLKMLLDATGGIVVTNDGNAILRELDIAHPAAKSMIELSRTQDEEVGDGTTSVIVLAGEMLHVAEAFIDKKYHPTVICRAYNKALEDALAVLDKISMSIDVNDRSMMLGLVKSCIGTKFTSQFGDLIADLALDATTIVGVDLGQGLREVDIKKYIKVEKIPGGQLEDSKVLKGVMFNKDVVVPGKMKRKIINPRIILLDCPLEYKKGENQTNAELVREEDWAVLLKMEEEYIENLCVQILKFKPDLVITEKGLSDLACHYLSKAGVSAIRRLRKTDNNRIAKACGAVIVNRPDELQESDVGTGAGLFEVKKIGDEFFAYIVDCKDPKACTVLLRGASKDLLNEVERNLQDAMSVARNILKHPKLVPGGGATELTVSATLKQKSSSIEGIEKWPYEAAAVAFEAIPRTLAQNCGVNVIRTMTALQGKHANGENAWTGIDGNSGEIADMKELKIWDAYNVKAQTFKTAIEAACMLLRIDDIVSGIKKRQAPGASQPSKPTVETEGDADNEQMIPE

SEQ ID NO: 6457 - protein, 556 aa, Quercus alba
MHAPVLVLKDSLKRESGSKVQHANIQASKAVADIIRTTLGPRSMLKMLLDATGGIVVTNDGNAILRELDLAHPAAKSMIELSRTQDEEVGDGTTSVIVLAGEMLHVAEAFLDKSYHPTVICRAYNKALEDAIAVLDRIAMPIDVKDRATMLGLVKSCIGTKFTSQFGDLIADLAIDATTTVGVDLGQGLREVDIKKYIKLEKIPGGQLEDSRVLKGVMFNKDVVAPGKMRRKIVNPRIILLDCPLEYKKGENQTNAELVREEDWEVLLRMEEEYIKNLCDQIVMFKPDLVITEKGLSDLACHYLCKHGVSAIRRLRKTDNNRIAKACGAVIVNRPDELQESDVGTGAGLFEVKKIGDEFFAFIVDCKEPKACTVLLRGASKDLLNEVERNLQDAMSVARNILKNPKLLPGGGATELTVSAALKQKSSSIEGIEKWPYEAAAIAFEAIPRTLAQNCGVNVIRTMTALQGKHANGENAWIGIDGNTGVITDMKERKIWDAYNVKAQTFKTAIEAASMLLRIDDIVSGIKKKQAPGAGAPSKPTVETEADADSEQILPD

SEQ ID NO: 6458 - protein, 556 aa, Tragopogon dubius
MQSPVLVLKDSLTRESGSKVHHGNIQASKAVADIIRTTLGPRSMLKMLLDASGGIVVTNDGNAILRELDIAHPAAKSMIELSRTQDEEVGDGTTSVIVLAGEMLHVAEAFIDKKYHPTVICRAYNKALEDALAVLDKISMSIDVNDRSMMLGLVKSCIGTKFTSQFGDLIADLALDATTTVGVDLGQGLREVDIKKYIKVEKIPGGRLEDSQVLKGVMFNKDVVVPGKMKRKIINPRIILLDCPLEYKKGENQTNAELVREEDWGVLLKMEEEYIENLCVQILKFKPDLVITEKGLSDLASHYLSKAGVSAIRRLRKTDNNRIAKACGAVIVNRPDELQESDVGTRAGLFEVKKIGDEFFAYIVECKDPKACTVLLRGASKDLLNEVERNLQDAMSVARNILKHPKLVPGGGATELTVSATLKQKSSSIEGIEKWPYEAAAIAFEAIPRTLAQNCGVNVIRTMTALQGKHANGENAWTGIDGNSGQIADMKELKIWDAYNVKAQTFKTAIEAACMLLRIDDIVSGIKKRQAPGASQPSKPTIEQEGDADNEQMIPE

SEQ ID NO: 6459 - protein, 557 aa, Amsonia hubrichtii
MQAPVLVLKDSLKRETGNKVHYGNIQASKAVADIIRTTLGPRSMLKMLLDVAGGIVVTNDGNAILRELDLAHPAAKSMIELSRTQDEEVGDGTTSVIVLAGEMLHVAEAFIGRNYHPTVICRAYNKALEDAIAVLDNIAMSIDVKDRASMLGLVKSCIGTKFTSQFGDLIADLAIDATSAVGVDLGQGLREVDIKKYIKVEKVPGGQLEDSKVLKGVMFNKDVVAPGKMRRKIVNPRIILLDCPLEYKKGENQTNAELMREEDWGVLLKMEEEYIKNLCMQILKFKPDLVITEKGLSDLACHYLSQAGVSAIRRLRKTDNNRIAKACGAVIVNRPDELQESDVGTGAGLFEVRKIGDEFFSFIVDCKDPKACTVLLRGASKDLLNEVERNLQDAMSVARNIIKHPKLVPGGGATELTVSAMLKQKSSSIEGIEKWPYEAAAIAFEAIPRTLAQNCGVNVIRTMTALQGKHANGENAWIGIDGNTGEITDMKERKIWDSYTVKAQAFKTAIEAACMLLRIDDIVSGIKKKQAPGAGSAPSKPKVEEEGEAENEALIPE

SEQ ID NO: 6460 - protein, 557 aa, Citrus sinensis
MHSPVLVLKDSLKRESGTKVHHANIQASKAVADIIRTTLGPRSMLKMLLDASGGIVVTNDGNAILRELDVAHPAAKSMIELSRTQDEEVGDGTTSVIVLAGEMLHVAEEFINKNYHPTVICRAYNKALEDAVAVLDTIAMPIDANDRATVLGLVKSCIGTKFTSQFGDLLADLAIDATTTVGVDLGQGLREVDIKKYIKVEKVPGGQLEDSRVLKGVMFNKDVVAPGKMRRKIVNPRIILLDSPLEYKKGENQTNAELVKEEDWGVMLKIEEDYIENLCMQIVKFKPDLVITEKGLSDLACHYLSKAGVSAIRRLRKTDNNRIAKACGAVIVNRPDELQESDVGTGAGLFEVKKIGDEFFAFIVDCKDPKACTVLLRGASKDLLNEVERNLQDAMSVARNIIKNPKLVPGGGATELTVSATLKQKSSSIEGIEKWPYEAAAIAFEAIPRTLAQNCGVNVIRTMTALQGKHANGENAWIGIDGNTGAISDMKEGKIWDAYNVKAQTFKTAIEAACMLLRIDDIVSGIKKKQAPGSGQAPSKPQIETEADADSEQILPD

SEQ ID NO: 6461 - protein, 556 aa, Triphysaria pusilla
MNSQVLVLKDNLKRESGSKVQHANIQASKAVADIIRTTLGPRSMLKMMLDAVGGIVVTNDGNAILRELDVAHPAAKSMIELSRTQDEEVGDGTTSVIILAGEMLHVAEAFIDKNYHPTVICRAYNKALEDAVAALDKIAMTVDVKDRAIMLGLVKSCIGTKFTSQFGDLIADLAIDATTTAGVELGQGLREVDIKKYIKVEKVPGSQLEDSKVLKGVMFNKDVVAPGKMRRKIVNPRIILLDCPLEYKKGENQTNAELLREEDWSVLLKMEEEYIENLCMEILKFKPDLVITEKGLSDLACHYFSKAGVSAIRRLRKTDNNRIAKACGAVIVNRPDELQESDVGTGAGLFEVKKIGDEFFAFIVDCKDPKACTVLLRGPSKDLLNEVERNLQDAMSVARNIIKNPKLVPGGGATELTVSAVLKQKSSSIEGVEKWPYEAAAIAFEAIPRTLAQNCGVNVIRTMTALQGKHANGENAWVGIDGNTGEITDMKERKIWDSYAVKAQAFKTAIEAACMLLRIDDIVSGIKKKQATGSGGPSKPQITQEGDADNESMIPE

SEQ ID NO: 6462 - protein, 477 aa, Ricinus communis
MIELSRTQDEEVGDGTTSVIVLAGEMLHVAEAFIDKSYHPTVICRAYIKALEDAIAVLDKIAMSIDVNDRATLLGLVKSCIGTKFTSQFGDLIADLAIDATTTVGVDLGQGLQVDIKKYIKVEKVPGGQLEDSKVLKGVMFNKDVVAPGKMRRKIVNPRIILLDCPLEYKKGENQTNAELVKEEDWAVLLKMEEEYIQNMCMQILTFKPDLVITEKGLSDLACHYLSRAGVGAIRRLRKTDNNRIAKACGAVIVNRPEELQESDVGTGAGLFEVKKIGDEFFSFIVDCKDPKACTVLLRGASKDLLNEVERNLQDAMSVARNILKNPKLLPGGGATELTVSATLKQKSSSVEGIEKWPYEAAALAFEAIPRTLAQNCGVNVIRTMTALQGKHANGDNAWVGIDGNTGEITDMKERKIWDAYNVKAQTFKTAIEAACMLLRIDDIVSGIKKKQAPGAGPSKPKIETEADADGEQILPD

SEQ ID NO: 6463 - protein, 556 aa, Artemisia annua
MQSPVLVLKDSLTRESGSKVHHANIQASKAVADIIRTTLGPRSMLKMLLDASGGIVVTNDGNAILRELDIAHPAAKSMIELSRTQDEEVGDGTTSVIVLAGEMLHVAEAFIDKKYHPTVICRAYVKALEDALAVLDKISMSIDVNDRSMMLGLVKSCIGTKFTSQFGDLIADLALDATTTVGVDLGQGIKEVDIKKYIKVEKIPGGQLEDSKVLKGVMFNKDVVVPGKMKRKIINPRVILLDCPLEYKKGENQTNAELVREEDWAVLLKMEEEYIENLCVQILKFKPDLVITEKGLSDLACHYFSKAGVSAIRRLRKTDNNRIAKACGAVIVNRPDELQESDVGTGAGLFEVKKIGDEFFAYIVDCKDPKACTVLLRGASKDLLNEVERNLQDAMSVARNILKHPKLVPGGGATELTVSATLKQKSSSVEGIEKWPYEAAAVAFEAIPRTLAQNCGVNVIRTMTALQGKHANGENAWTGIDGNSGEIADMKELKIWDAYNVKAQTFKTAIEAACMLLRIDDIVSGIKKRQAPGSSQPSKPTIETGDDADNEQMIPE

SEQ ID NO: 6464 - protein, 557 aa, Citrus sinensis
  misc_feature (556)..(556): Xaa can be any naturally occurring amino acid
MHSPVLVLKDSLKRESGTKVHHANIQASKAVADIIRTTLGPRSMLKMLLDASGGIVVTNDGNAILRELDVAHPAAKSMIELSRTQDEEVGDGTTSVIVLAGEMLHVAEEFINKNYHPTVICRAYNKALEDAVAVLDTIAMPIDANDRATVLGLVKSCIGTKFTSQFGDLLADLAIDATTTVGVDLGQGLREVDIKKYIKVEKVPGGQLEDSRVLKGVMFNKDVVAPGKMRRKIVNPRIILLDSPLEYKKGENQTNAELVKEEDWGVMLKIEEDYIENLCMQIVKFKPDLVITEKGLSDLACHYLSKAGVSAIRRLRKTDNNRIAKACGAVIVNRPDELQESDVGTGAGLFEVKKIGDEFFAFIVDCKDPKACTVLLRGASKDLLNEVERNLQDAMSVARNIIKNPKLVPGGGATELTVSATLKQKSSSIEGIEKWPYEAAAIAFEAIPRTLAQNCGVNVIRTMTALQGKHANGENAWIGIDGNTGAISDMKEGKIWDAYNVKAQTFKTAIEAACMLLRIDDIVSGIKKKQAPGSGQAPSKPQIETEADADSEQILXD

SEQ ID NO: 6465 - protein, 557 aa, Citrus clementina
MHSPVLVLKDSLKRESGTKVHHANIQASKAVADIIRTTLGPRSMLKMLLDASGGIVVTNDGNAILRELDVAHPAAKSMIELSRTQDEEVGDGTTSVIVLAGEMLHVAEEFINKNYHPTVICRAYNKALEDAVAVLDTIAMPIDANDRATVLGLVKSCIGTKFTSQFGDLLADLAIDATTTVGVDLGQGLREVDIKKYIKVEKVPGGQLEDSRVLKGVMFNKDVVAPGKMRRKIVNPRIILLDSPLEYKKGENQTNAELVKEEDWGVMLKIEEDYIENLCMQIVKFKPDLVITEKGLSDLACHYLSKAGVSAIRRLRKTDNNRIAKACGAVIVNRPDELQESDVGTGAGLFEVKKIGDEFFAFIVDCKDPKACTVLLRGASKDLLNEVERNLQDAMSVARNIIKNPKLVPGGGATELTVSATLKQKSSSIEGIEKWPYEAAAIAFEAIPRTLAQNCGVNVIRTMTALQGKHANGENAWIGIDGNTGAISDMKEGKIWDAYNVKAQTFKTAIEAACMLLRIDDIVSGIKKKQAPGSGQAPSKPQIETEADADSEQILHD

SEQ ID NO: 6466 - protein, 556 aa, Coffea canephora
MHAPVLVLKDTLKRESGNKVHYANIQASKAVADIIRTTLGPRSMLKMLLDAAGGIVVTNDGNAILRELDLAHPAAKSMIELSRTQDEEVGDGTTSVIVLAGEMLHVAEAFIDNNYHPTVICRAYNKALEDAIAALEKIAMTVDVKDRATMLGLVKSCIGTKFTSQFGNLIADLAIDATTTVGVEVGQGIREVDIKKYVKVEKVPGGQLEDSQVLKGVMFNKDVVAPGKMRRKIVNPRIILLDCPLEYKKGENQTNAELLREEDWSVLLKMEEEYIENLCMQILKFKPDLVITEKGLSDLACHYLSKAGVSAIRRLRKTDNNRIAKACGAVIVNRPDELQESDVGTGAGLFEVRKIGDEFFAFIVDCKDPKACTVLLRGASKDLLNEVERNLQDAMSVARNIVKNPKLVPGGGATELTVSAILKQKSSSVEGIEKWPYEAAAIAFEAIPRTLAQNCGVNVIRTMTSLRGTHANGENAWVGIDGNTGAIADMKERKIWDSYTVKVQAFKTAIEAACMLLRIDDIVSGIKKKQAPGAGASSKPKVEEEGEAENEALIPE

SEQ ID NO: 6467 - protein, 564 aa, Momordica charantia
MHAPVLVLKDSLKRESGSKVHHANIQASKAVADIIRTTLGPRSMLKMLLDASGGIVVTNDGNAILRELDIAHPAAKSMIELSRTQDEEVGDGTTSVIVLAGEMLHVAEAFIEKNYHPTVICRAYNKALEDALAVLDKIAMDIDVEDRTAMLGLVKSCIGTKFTSQFGDLIADLAIDATTIVGVDLGQGLREVDIKKYIKVEKVPGGQLEDSRVLKGVMFNKDVVAPGKMRRKIVNPRIILLDCPLEYKKGENQTNAELVKEEDWGILLKMEEEYIENICAQIIKFKPDLVITEKGLSDLACHYLSKAGISAIRRLRKTDNNRIAKACGAVIVNRPDELQESDVGTGAGLFEVKKIGDEFFSFIVDCKDPKACTILLRGASKDLLNEVERNLQDAMSVARNIIKNPKLVPGGGATELTVSATLKQKSSSIEGIEKWPYEAAALAFEAIPRTLAQNCGVNVIRTMTALQGKHANGENAWTGIDGNSGEITDMKERKIWDVYNVKSQTFKTAIEASCMLLRIDDIVSGIKKKQAPGQGPSKPKIETEADADNEQILPELNFWLSQFY

SEQ ID NO: 6468 - protein, 555 aa, Mimulus guttatus
MHAPVLVLKDTLKRESGSKVQHANIQASKAVADIIRTTLGPRSMLKMLLDASGGIVVTNDGNAILRELDVAHPAAKSMIELSRTQDEEVGDGTTSVIVLAGEMLHVAEAFIDKKYHPTVICRAYGKALEDAVAVLDKIAMTVDINDHATMLGLVKSCIGTKFTSQFGDLIANLAIDATTTAGVDVGQGLREVDIKKYIKVEKIPGGQLEDSKVLKGVMFNKDVVAPGKMKRKILNPRIMLLDCPLEYKKGENQTNAELLREEDWSVLLKMEEEYIENLCAQILKFKPDLVITEKGLSDLACHYFSKAGVSAIRRLRKTDNNRIARACGAVIVNRPDELQESDIGTGAGLFEVRKIGDEFFAFIVDCKDPKACTVLLRGASKDLLNEVERNLQDAMAVARNIIKNPKLVPGGGATELTVSAMLKQKSSSIEGVEKWPYEAAAMAFEAIPRTLAQNCGVNVIRIMTALQGKHANGENAWIGIDGNTGEITDMKERKIWDSYTVKAQAFKTAIEAACMLLRIDDIVSGIKKKQAGAGGPSKPTIEEEGNADNENMIPE

SEQ ID NO: 6469 - protein, 556 aa, Tropaeolum majus
MNAPVLVLKDSLKRESGSKVQHANIQASKAVADIIRTTLGPRSMLKMLLDASGGIVVTNDGNAILRELDIAHPAAKSMIELSRTQDEEVGDGTTSVIVLAGEMLHVAEAFIDKNYHPTVICRAYIKALEDAIAVIDKIAMPIDAKDRSTMLSLVKSCIGTKFTSQFGDLIADLAIDATTTVGVDLGQGLREVDIKKYIKVEKVPGGQLEDSSVLKGVMFSKDVVAPGKMRRKIINPRIILLDCPLEYKKGENQTNAELVREEDWAVLLKLEEEYIENICMQIIKFKPDLVITEKGLSDLACHYLSKAGITAIRRLRKTDNNRIAKACGAVIVNRPDELQESDVGTGAGLFEVKKIGDEFFAFIVDCKDPKACTVLLRGPSKDLLNEVERNLQDAMSVARNIIKNPKLLPGGGATELTVSATLKAKSSSIEGIEKWPYEAAAIAFEAIPRTLAQNCGVNVIRTMTTLQGKHANGENAWTGIDGNTGAIVDMKERKIWDAYNVKAQTFKTAIEAACMLLRIDDIVSGIKKKQAPGAGQSQKPKIETENDADGEQILPD

SEQ ID NO: 6470 - protein, 364 aa, Tropaeolum majus
MNAPVLVLKDSLKRESGSKVQHANIQASKAVADIIRTTLGPRSMLKMLLDASGGIVVTNDGNAILRELDIAHPAAKSMIELSRTQDEEVGDGTTSVIVLAGEMLHVAEAFIDKNYHPTVICRAYIKALEDAIAVIDKIAMPIDAKDRSTMLSLVKSCIGTKFTSQFGDLIADLAIDATTTVGVDLGQGLREVDIKKYIKVEKVPGGQLEDSSVLKGVMFSKDVVAPGKMRRKIINPRIILLDCPLEYKKGENQTNAELVREEDWAVLLKLEEEYIENICMQIIKFKPDLVITEKGLSDLACHYLSKAGITAIRRLRKTDNNRIAKACGAVIVNRPDELQESDVGTGAGLFEVKKNWGRVLCIYC

SEQ ID NO: 6471 - protein, 81 aa, Prunus persica
MQAPVLVLKDSLKRESGTKVHHGNIQASKAVADIIRTTLGPRSMLKMLLDASGGIVVTNDGNAILRELDIAHPAAKACHFQ

SEQ ID NO: 6472 - protein, 556 aa, Cirsium arvense
MQSPVLVLKDSLTRESGSKVHHANIQASKAVADIIRTTLGPRSMLKMLLDAQGGIVVTNDGNAILRELDIAHPAAKSMIELSRTQDEEVGDGTTSVIVLAGEMLHVAEAFIDKKYHPTVICRAYNKALEDALAVLDKISMSIDVNDRSMMLGLVKSCIGTKFTSQFGDLISDLALDATTIVGVDIGQGLREVDIKKYIKVEKIPGGQLEDSKVLKGVMFSKDVVVPGKMKRKIVNPRIILLDCPLEYKKGENQTNAELVREEDWAVLLKMEEEYIENLCVQILKFKPDLVITEKGLSDLACHYFSKAGVSAIRRLRKTDNNRIAKACGAVIVNRPDELQESDVGTGAGLFEVKKIGDEFFAYIVDCKDPKACTVLLRGASKDLLNEVERNLQDAMSVARNILKHPKLVPGGGATELTVSATLKQKSSSIEGIEKWPYEAAAVAFEAIPRTLAQNCGVNVIRTMTALQGKHANGENAWTGIDGNTGEISDMKELKIWDAYNVKAQTFKTAIEAACMLLRIDDIVSGIKKRQAPGASQPSKPTIEQEGEADNEQMIPE

SEQ ID NO: 6473 - protein, 555 aa, Cajanus cajan
MHAPVLVLKDSLKRESGAKVRYAVIQAAKAVADVVRTTLGPRSMLKMLLDAQGGIVVTNDGNAILRELDLAHPAAKSMIELSRTQDEEVGDGTTSVIILAGEMLHVADAFIDKIHPTVICRAYTKALEDAIAVLDKIAMPIDAQDRGIMLGLVKSCIGTKFTGQFGDLIADLAIDATTTVGVDIGHGLRDVDIKNYIKVEKVPGGQLEDSRVLKGVMINKDVVAPGKMRRKIVNPRIILLDSPLEYKKGENQTNAELLKEEDWSLLLKMEEEYIEELCMQILKFKPDLVITEKGLSDLACHYLSKHGVSAIRRLRKTDNNRIAKACGAVIVNRPDELQESDVGTGAGLFEVKKIGDEYFAFIVDCKDPKACTVLLRGASKDLLNEVERNLQDAMSVARNIIKNPKLVPGGGATELTVSAALKQKCSSIEGIEKWPYEAAAIAFEAIPRTLAQNCGVNVIRTMTALQGKHANGENAWIGIDGNTGSITDMKEAKIWDAYNVKAQAFKTAIEAACMLLRIDDIVSGIKKKQAPGASAPSKPKVETEADADGEQILPD

SEQ ID NO: 6474 - protein, 256 aa, Ambrosia trifida
QSPVLVLKDSLTRESGSKVHHANIQASKAVADIIRTTLGPRSMLKMLLDAQGGIVVTNDGNAILRELDIAHPAAKSMIELSRTQDEEVGDGTTSVIVLAGEMLHVAEAFIDKKYHPTVICRAYSKALEDALAVLDKISMSIDVNDRSMMLGLVKSCIGTKFTSQFGDLIADLALDATTTVGVDLGQGIREVDIKKYIKVEKIPGGQLEDSKVLKGVMFNKDVVVPGKMKRKIINPRIILLDCPLEYKKGENQQMLS

SEQ ID NO: 6475 - protein, 383 aa, Flaveria ramosissima
MQSPVLVLKDSLTRESGTKVHHANIQASKAVADIIRTTLGPRSMLKMLLDAQGGIVVTNDGNAILRELDIAHPAAKSMIELSRTQDEEVGDGTTSVIVLAGEMLHVAEAFIDKKYHPTVICRAYNKALEDALAVLDKISMSIDVNDRSMMLGLVKSCIGTKFTSQFGDLIADLALDATTTVGVDLGQGIREVDIKKYIKVEKIPGGQLEDSKVLKGVMFNKDVVVPGKMKRKIINPRIILLDCPLEYKKGENQTNAELVREEDWAVLLKMEEEYIENICVQILKFKPDLVITEKGLSDLACHYFSKAGVSAIRRLRKTDNNRIAKACGAVIVNRPDELQESDVGTGAGLFEVKRLVMNFLHLLWIVKTRKRAPFFSEVLARIF

SEQ ID NO: 6476 - protein, 556 aa, Cirsium arvense
MQSPVLVLKDSLTRESGSKVHHANIQASKAVADIIRTTLGPRSMLKMLLDAQGGIVVTNDGNAILRELDIAHPAAKSMIELSRTQDEEVGDGTTSVIVLAGEMLHVAEAFIDKKYHPTVICRAYNKALEDALAVLDKISMSIDVNDRSMMLGLVKSCIGTKFTSQFGDLIADLALEATTTVGVDIGQGLREVDIKKYIKVEKIPGGQLEDSKVLKGVMFSKDVVVPGKMKRKIVNPRIILLDCPLEYKKGENQTNAELVREEDWAVLLKMEEEYIENLCVQILKFKPDLVITEKGLSDLACHYFSKAGVSAIRRLRKTDNNRIAKACGAVIVNRPDELQESDVGTGAGLFEVKKIGDEFFAYIVDCKDPKACTVLLRGASKDLLNEVERNLQDAMSVARNILKHPKLVPGGGATELTVSATLKQKSSSIEGIEKWPYEAAAVAFEAIPRTLAQNCGVNVIRTMTALQGKHANGENAWTGIDGNSGEIADMKELKIWDAYNVKAQTFKTAIEASCMLLRIDDIVSGIKKRQAPGASQPSKPTIEQEGEADNEQMIPE

SEQ ID NO: 6477 - protein, 233 aa, Helianthus annuus
MQSPVLVLKDSLTRESGSKVHHGNIQASKAVADIIRTTLGPRSMLKMLLDAAGGIVVTNDGNAILRELDVAHPAAKSMIELSRTQDEEVGDGTTSVIVLAGEMLHVAEAFIDKKYHPTVICRAYNKALEDALAVLDKISMSIDVNDRSMMLGLVKSCIGTKFTSQFGDLIADLALDATTTVGVDLGQGLREVDIKKYIKVEKIPGGQLEDSKVLKGVMFNKDVVVPGKMKRKS

SEQ ID NO: 6478 - protein, 556 aa, Valeriana officinalis
MQSPVLVLKDSLTRESGSKVHHGNIQASKAVADIIRTTLGPRSMLKMLLDASGGIVVTNDGNAILRELDVAHPAAKSMIELSRTQDEEVGDGTTSVIVLAGEMLHVAEAFIDKSYHPTVICRAYNKALEDALAVLDKISMSIDVNDRDMMMGLIKSCIGTKFTSQFGDLIAELALEATTTIGVDIGQGVREVDIKKYIKVEKIPGGQLEDSHVLKGVMFNKDVVVPGKMRRKIVNPRIILLDCPLEYKKGENQTNAELVREEDWGVLLKMEEEYIENLCAQILRFEPDLVITEKGLSDLACHYLSKAGVSAIRRLRKTDNNRIAKACGAVIVNRPDELQESDVGTGAGLFEVKKIGDEFFSYIVECKDPKACTVLLRGASKDLLNEVERNLQDAMSVARNIIKNPKLVPGGGATELTVSATLKQKSSSVEGIEKWPYEAAAVAFEAIPRTLAQNCGVNVIRTMTALQGKHANGENAWVGIDGNSGVISDMKELKIWDAYNVKAQTFKTAIEAACMLLRIDDIVSGIKKKAAPGSQAPSKPGIEQEGDADNEQMIPE

SEQ ID NO: 6479 - protein, 556 aa, Vinca minor
MHAPVLVLKDSLKRESGNKVHYGNIQASKAVADIIRTTLGPRSMLKMLLDAAGGIVVTNDGNAILRELDIAHPAAKSMIELSRTQDEEVGDGTTSVIILAGEMLHVAEAFIGRSYHPTVICRAYNKALEDALAVLDEISMSIDVKDRASMLGLIKSCIGTKFTSQFGDLIADLAIDATSTVDVELGQGLREVDIKKYIKVEKVPGGQLEDSKVLKGVMINKDVVAPGKMRRKIVNPRIILLDCPLEYKKGENQTNAELMREEDWSVLLKMEEEYIDNLCAQILRFKPDLVITEKGLSDLACHYLSKAGVSAIRRLRKMDNNRIAKACGAVIVNRPDELQESDVGTGAGLFEVRKIGDDFFSFIVDCKDPKACTVLLRGASKDLLNEVERNLQDAMSVARNIIKNPKLVPGGGATELTVSATLKQKSSSVEGIEKWPYEAAAIAFEAIPRTLAQNCGVNVIRTMTALQGKHANGENAWIGIDGNTGEITDMKERKIWDSYTVKAQAFKTAIEAACMLLRIDDIVSGIKKQAPGSGSAPSKPKVDEEGEADNEALIPE

SEQ ID NO: 6480 - protein, 555 aa, Arabidopsis lyrata
MHAPVLVLSDSLKRESGSKVHHGNIQASKAVADIIRTTLGPRSMLKMLLDASGGIVVTNDGNAILRELDVAHPAAKSMIELSRTQDEEVGDGTTSVIVLAGEMLHVAEAFIEKNYHPTVICRAYIKALEDSIAVLDKIAMSIDINDRSSVLGLVKSCIGTKFTSQFGDLIADLAIDATTTVGVDLGQGLREVDIKKYIKVEKVPGGQFEDSEVLKGVMFNKDVVAPGKMKRKIVNPRIILLDCPLEYKKGENQTNAELVREEDWEVLLKLEEEYIENICVQILKFKPDLVITEKGLSDLACHYFSKAGVSAIRRLRKTDNNRIAKACGAVIVNRPDELQESDIGTGAGLFEVKKIGDDFFSFIVDCKEPKACTVLLRGPSKDFINEVERNLQDAMSVARNIIKNPKLVPGGGATELTVSATLKQKSATIEGIEKWPYEAAAIAFEAIPRTLAQNCGVNVIRTMTALQGKHANGENAWTGIDGNTGAIADMKESKIWDSYNVKAQTFKTAIEAACMLLRIDDIVSGIKKKQAPGSGPSKPTIETEGDADNEQILPD

SEQ ID NO: 6481 - protein, 557 aa, Aristolochia fimbriata
MQTPVLALKDSLTHESGTKVHHANIQAAKAVADIIRTTLGPRSMLKMLLDAAGGIVVTNDGNSILRELDIAHPAAKSMIELSRTQDEEVGDGTTSVIVLAGEMLHVAEAFINKSFHPTVICRAYNQALEDALAVLDKIAVSIDVDDRTTMLGLVKTCIGTKFTSQFGNLIADLALDATTMVGVDLGQGYKEVDIKKYVKVEKVPGGQLEDSKVLKGVMFNKDVVAPGKMRRKIVNPRIILLDCPLEYKKGENQTNAELVKEEDWAVLLKMEEEYIENVCMQILKFKPDVVITEKGLSDLACHYLSKAGVSAIRRLRKTDNNRIAKACGAVIVNRPEELQESDVGTGAGLFEVKKIGDEFFTFIVDCKNPKACTVLLRGASKDLLNEVERNLQDATSVARNIIKNPKLVPGGGATELTVSATLKQKSSSVEGIEKWPYEAAAIAFEAIPRTLAQNCGVNVIRTMTALQGKHANGENAWTGIDGNTGEITDMKERKIWDSYDVKAQTFKTAIEAACMLLRIDDIVSGIKKKQAPGAGQAPQKPKIEEEGDADNEQTIPE

SEQ ID NO: 6482 - protein, 444 aa, Helianthus annuus
MQSPVLVLKDSLTRESGSKVHHGNIQASKAVADIIRTTLGPRSMLKMLLDAQGGIVVTNDGNAILRELDIAHPAAKSMIELSRTQDEEVGDGTTSVIVLAGEMLHVAEAFIDKKYHPTVICRAYIKALEDALAVLDKISMSIDVNDRSMMLGLVKSCIGTKFTSQFGDLIADLALDATTTVGVDLGQGIREVDIKKYIKVEKIPGGQLEDSKVLKGVMFNKDVVVPGKMKRKIINPRIILLDCPLEYKKGENQTNAELVREEDWAILLKMEEEYIENICVQILKFKPDLVITEKGLSDLACHYFSKAGVSAIRRLRKTDNNRIAKACGAVIVNRPDELQESDVGTGAGLFEVKKIGDEFFSFIVDCKDPKACTILLRGASKDLLNEVERNLQDAMSVARNILKHPKLVPGGGATELTVSATLKQKSSSIEGIEKWPYEAAAVAF

SEQ ID NO: 6483 - protein, 257 aa, Amorphophallus konjac
MHAPVLVLKDSLKRESGAKVHHANIQASKAVADIIRTTLGPRSMLKMLLDTGGGIVVTNDGNAILRDLDLAHPAAKSMIELSRTQDEEVGDGTTSVIILAGELLHVAEAFIDKNYHPTVVCRAYTKALEDAIAVLDKIAMPIDVNDRATMLGLVKSSIGTKFTSQFGNLIADLAIDATTTVGVDLGQGLREVDIKNYIKVEKVPGGPLEDSKVLKGVMINKDVVAPGKMRRRILNPRIILLDCPLEYKKGETRQMQS

SEQ ID NO: 6484 - protein, 555 aa, Unknown
  Sequence found in Organisms: Brassica napus, Brassica rapa
MNAPVLVLKDSLKRESGTKVHHGNIQASKAVADIIRTTLGPRSMLKMLLDAGGGIVVTNDGNAILRELDVAHPAAKSMIELSRTQDEEVGDGTTSVIVLAGEMLHVAEAFIEKSYHPTVICRAYNKALEDAIAVLDKIAMSIDVNDRATVLGLVKSCIGTKFTSQFGDLIADLAIDATTTVGVDLGQGLREVDIKKYIKVEKVPGGQLEDSKVLKGVMFNKDVVAPGKMKRKIVNPRIILLDCPLEYKKGENQTNAELVREEDWEVLLKLEEEYIENICVQILKFKPDLVITEKGLSDLACHYFSKAGVSAIRRLRKTDNNRIAKACGAVIVNRPDELQESDVGTGAGLFEVKKIGDDFFAFVVDCKEPKACTVLLRGPSKDLLNEVERNLQDAMSVSRNIIKNPKLVPGGGATELTVSATLKQKSATIEGIEKWPYEAAAIAFEAIPRTLAQNCGVNVIRTMTALQGKHANGENAWTGIDGNTGAIADMKESKIWDAYNVKAQTFKTAIEAACMLLRIDDIVSGIKKKQAPGAGPSKPTIETEGDADNEQILPD

SEQ ID NO: 6485 - protein, 338 aa, Brassica napus
MFNKDVVAPGKMKRKIVNPRIILLDCPLEYKKGENQTNAELVREEDWEVLLKLEEEYIENICVQILKFKPDLVITEKGLSDLACHYFSKAGVSAIRRLRKTDNNRIAKACGAVIVNRPDELQESDVGTGAGLFEVKKIGDDFFAFVVDCKEPKACTVLLRGPSKDLLNEVERNLQDAMSVSRNIIKNPKLVPGGGATELTVSATLKQKSATIEGIEKWPYEAAAIAFEAIPRTLAQNCGVNVIRTMTALQGKHANGENAWTGIDGNTGAIADMKESKIWDAYNVKAQTFKTAIEAACMLLRIDDIVSGIKKKQAPGAGPSKPTIETEGDADNEQILPD

SEQ ID NO: 6486 - protein, 555 aa, Trigonella foenum-graecum
MQSSVLVLKDSLKRESGAKVHHANIQASKAVADIIRTTLGPRSMLKMLLDASGGIVVTNDGNAILRELDIAHPAAKSMIELSRTQDEEVGDGTTSVIILAGEMLHVAEAFIDKNYHPTVICRAYNKALEDAIAAIDKIAMPIDAQDRGQMLGLVKSCIGTKFTSQFGDLIADLAIDATTTVGVDIGQGLRDVDIKNYIKVEKVPGAQLEDSRVLKGVMFNKDVVAPGKMRRKIVNPRIILLDCPLEYKKGENQTNAELLREEDWSLLLKLEEEYIEELCMQILKFKPDLVVTEKGLSDLACHYLSKHGVSAIRRLRKTDNNRIAKACGAVIVNRPDELQESDVGTGAGLFEVKKIGDEYFAFVVDCKEPKACTVLLRGASKDLLNEVERNLQDAMSVARNIIKNPKLVPGGGATEMTVSATLKQKSSSIEGIEKWPYEAAAIAFESIPRTLAQNCGVNVIRTMTALQGKHANGENAWIGIDGNTGAIADMKERKIWDAYNVKAQTFKTAIEAACMLLRIDDIVSGIKKKQAPGAGPSKPKIETEGDADGEQILPD

SEQ ID NO: 6487 - protein, 555 aa, Arabidopsis thaliana
MHAPVLVLSDSLKRESGSKVHHGNIQASKAVADIIRTTLGPRSMLKMLLDAGGGIVVTNDGNAILRELDVAHPAAKSMIELSRTQDEEVGDGTTSVIVLAGEMLHVAEAFLEKNYHPTVICRAYIKALEDSIAVLDKIAMSIDINDRSQVLGLVKSCIGTKFTSQFGDLIADLAIDATTTVGVDLGQGLREVDIKKYIKVEKVPGGQFEDSEVLKGVMFNKDVVAPGKMKRKIVNPRIILLDCPLEYKKGENQTNAELVREEDWEVLLKLEEEYIENICVQILKFKPDLVITEKGLSDLACHYFSKAGVSAIRRLRKTDNNRIAKACGAVIVNRPDELQESDIGTGAGLFEVKKIGDDFFSFIVDCKEPKACTVLLRGPSKDFINEVERNLQDAMSVARNIIKNPKLVPGGGATELTVSATLKQKSATIEGIEKWPYEAAAIAFEAIPRTLAQNCGVNVIRTMTALQGKHANGENAWTGIDGNTGAIADMKESKIWDSYNVKAQTFKTAIEAACMLLRIDDIVSGIKKKQAPGSGPSKPTIETEGDADNEQILPD

SEQ ID NO: 6488 - protein, 556 aa, Raphanus sativus
  misc_feature (237)..(237): Xaa can be any naturally occurring amino acid
MNAPVLVLKDSLKRESGTKVHHGNIQASKAVADIIRTTLGPRSMLKMLLDAGGGIVVTNDGNAILRELDVAHPAAKSMIELSRTQDEEVGDGTTSVIVLAGEMLHVAEAFIEKSYHPTVICRAYNKALEDAIAVLDKIAMPVDVNDRETVLGLVKSCIGTKFTSQFGDLIADLAIDATTTVGVDLGQGLREVDIKKYIKVEKVPGGQLEDSKVLKGVMFNKDVVAPGKMKRKIVNPXIILLDCPLEYKKGENQTNAELVREEDWEVLLKLEEEYIENICVQILKFKPDLVITEKGLSDLACHYFSKAGVSAIRRLRKTDNNRIAKACGAVIVNRPDELQESDVGTGAGLFEVKKIGDDFFAFVVDCKEPKACTVLLRGPSKDLLNEVERNLQDAMSVSRNIIKNPKLVPGGGATELTVSATLKQKSATIEGIEKWPYEAAAIAFEAIPRTLAQNCGVNVIRTMTALQGKHANGENAWTGIDGNTGAIADMKESKIWDAYNVKAQTFKTAIEAACMLLRIDDIVSGIKKQQAPGAGGPSKPTIETEGDADNEQILPD

SEQ ID NO: 6489 - protein, 557 aa, Amborella trichopoda
MHAPVLVLKDSLKRESGTKVHHANIQASKAVADIIRTTLGPRSMLKMLLDAAGGIVVTNDGNCILRELDLAHPAAKSMIELSRTQDEEVGDGTTSVIVLAGEMLHVAEAFIDKSYHPTVICRAYSKALEDSIAVLDKIAVPIDVNDRATMLKLVKSCIGTKFTGQFGDLIADLAIGATTTIGVDLGQGIKEVDIKKYIKVEKIPGGQLEDSKVLKGVMINKDVVSPGKMKRKILNPRIILLDCPLEYKKGENQTNAELLKEEDWSVLLKMEEEYIESLCAQILKFQPDLVITEKGLSDLACHYLSKAGVSAIRRLRKTDNNRIAKACGAVVVNRPDELQESDVGTGAGLFEVKKIGDEFFAFITNCKDPKACTVLVRGASKDLLNEVERNLQDAMSVARNIIKNPKLVPGGGASELTVSATLKQKSSSIEGIEKWPYEAVAVAFEAIPRTLAQNCGVNVIRTMTALQGKHANGENAWIGIDGNTGTIVDMKEKGIWDAYNVKAQTFKTAIEAACMLLRIDDIVSGIKKKQSGGAGSAPKQPQVDQEDDADGEQILPE

SEQ ID NO: 6490 - protein, 556 aa, Castanea mollissima
MHAPVLVLKDSLKRESGSKVQHANIQASKAVADIIRTTLGPRSMLKMLLDGGGNIVVTNDGNAILRELDLAHPAAKSMIELSRTQDEEVGDGTTSVIVLAGEMLHVAEAFLDKSYHPTVICRAYNKALEDAIAVLDKIAMPIDVNDRATMLSLVKSCIGTKFTSQFGDLIADLAIDATTTVGVDLGQGLREVDIKKYIKVEKIPGGQLEDSKVLKGVMFNKDVVAPGKMRRKIVNPRIILLDCPLEYKKGENQTNAELVREEDWEVLLRMEEEYIKNLCDQIVMFKPDLVITEKGLSDLACHYLCKHGVSAIRRLRKTDNNRIAKASGAVIVNRPDELQESDVGTGAGLFEVKKIGDEFFAFIVDCKEPKACTVLLRGASKEFLSEVDRNLQDAMSVARNIIKNPKLLPGGGATELTVSAALKQKSSSIEGIEKWPYEAAAMAFEAIPRTLAQNCGVNVIRTMTALQGKHANCENAWIGIDGNTGVITDMKERKIWDAYNVKAQTFKTAIEAASMLLRIDDIVSGIKKKQAPGAGAPSKPTVETEADADSEQILPD

SEQ ID NO: 6491 - protein, 557 aa, Orobanche aegyptiaca
MHAPVLVLNDALKRESGSKVHRGNIQASKAVADIIRTTLGPRSMLKMLLDAAGGIVVTNDGNAILRELDVAHPAAKSMIELSRTQDEEVGDGTTSVIILAGEMLHVAEAFIDKNYHPTVICRAYNKALEDAISVLNKIAVIIDVKDRATMLGILKSCIGTKFTSQFGDLIADLAIDATTTAGVDLGQGLREVDIKKYIKVEKVPGGQLEDSEVLKGVMLNKDVIAPGKMRRKILNPRIMLLDCPLEYKKGENQTNAELQREEDWSVLLKMEEEYIEKECMQILKLKPDVVMTEKGISDLACHYLSKAGVSAIRRLRKTDNNRIAKACGAVIVNRPDELQESDIGTGAGLFEVRKIGDEFFAFIVDCKEPKACTVLLRGASKDLLNEVERNLQDAMSVARNIIKNPKLVPGGGATELTVSATLKQKSSSVEGIEKWPYEAAAIAFEAIPRTLAQNCGVNVIRTMTALQGKHANGENAWVGIDGNTGEITDMKERKIWDSYTVKAQAFKTAIEAACMLLRIDDIVSGIKKKQSPGASQVPSKPQIEQEGDADNENIIPE

SEQ ID NO: 6492 - protein, 554 aa, Glycine max
MHAPVLVLKDSLKRESGSKVRYAIIQAAKAVADVVRTTLGPRSMLKMLLDAQGGIVVTNDGNAILRELDLAHPAAKSMIELSRTQDEEVGDGTTSVIILAGEMLHVADAFIDKIHPTVICRAYNKALEDAIAVLDKIAMPIDAQDRGIMLGLVKSCIGTKFTGQFGDLIADLAIDATTTVGVEIGQGLRDVDIKNYIKVEKVPGGQLEDSRVLKGVMINKDVVAPGKMRRRIVNPHIILLDSPLEYKKGENQTNAELLKEEDWSLLLKMEEEYIEELCMQILKFKPDLVITEKGLSDLATHYLSKHGVSAIRRLRKTDNNRIAKACGAVIVNRPDELQESDVGTGAGLFEVKKIGDEYFAYIVDCKEPKACTVLLRGASKDLLNEVERNLQDAMSVARNIIKNPKLVPGGGATELTVSAALKQKSSSIEGIEKWPYEAAALAFEAIPRTLAQNCGVNVIRTMTALQGKHANGENAWIGIDGNTGSITDMKERKIWDAYNVKAQAFKTAIEAACMLLRIDDIVSGIKKKQAPGAAPSKPKVETEADADSEQILPD

SEQ ID NO: 6493 - protein, 127 aa, Phalaenopsis aphrodite
MHAPVLVLKDSLKREQGNKVQHANIHASKAVADIIRTTLGPRSMLKMLLDATGGIVVTNDGNAILRELDLAHPAAKSMIELSRTQDEEVGDGTTSVIVLAGEMLHVAEAFIDKNYHPTVIVEHTTEL

SEQ ID NO: 6494 - protein, 556 aa, Beta vulgaris
MHAPVLVLNDSTKRESGSKVHHANIRAAKAVAEVIRTTLGPRSMLKMLLDAAGGIVVTNDGNAILRELDLAHPAAKSMIELSRTQDEEVGDGTTSVIVLAGEMLHVAEEFIDKSYHPTVICRAYSKALEDALAVLDKIAMSIDVEDRATMLGLVKSCIGTKFTSQFGDLIADLAIDATAMVGVDLGQGLREVDIKKYIKVEKVPGGQLEDSQVLKGVMINKDVVAPGKMRRKIINPRIMLLDCPLEYKKGENQTNAEILKDEDWEVLLRMEEEFIENMCAQILKFKPDLVITEKGLSDLACHYLSKAGVTAIRRVRKTDNNRIAKACGAVIVNRPDELQESDVGTGAGLFEVKKIGDEFFAFIVDCKEPKACTVLLRGASKDLLNEVERNLQDAMCVARNIIKSPKLVPGGGGTELTVSATLKQKSSSIEGIEKWPYEAAALAFEAIPRTLAQNCGVNVIRTMTALRGKHANGENAWTGIDGNTGEIADMKEKKIWDSYAVKAQTFKTAIEAACMLLRIDDIVSGIKKKQAPGAQAPSKPSVEQADDADNEQMIPE

SEQ ID NO: 6495 - protein, 555 aa, Eutrema halophilum
MHAPVLVLNDSLKRESGTKVHHNNIQASKAVADIIRTTLGPRSMLKMLLDAGGGIVVTNDGNAILRELDVAHPAAKSMIELSRTQDEEVGDGTTSVIVLAGEMLHVAEAFIEKSYHPTVICRAYIKALEDSIAVLDKIAMTIDVNDRATVLGLVKSCIGTKFTSQFGDLIADLAIDATTTIGVDLGQGLREVDIKKYIKVEKVPGGQLEDSKVLTGVMFNKDVVAPGKMKRKIVNPRIILLDCPLEYKKGENQTNAELVREEDWEVLLKLEEEYIENICVQILKFKPDLVITEKGLSDLACHYFSKAGVSAIRRLRKTDNNRIAKACGAVIVNRPDELQESDIGTGAGLFEVKKIGDDFFAFIVDCKEPKACTVLLRGPSKDLLNEVERNLQDAMSVARNIIKNPKLVPGGGATELTVSATLKQNSATIEGIEKWPYEAAAIAFEAIPRTLAQNCGVNVIRTMTALQGKHANGENAWTGIDGNSGAIADMKESKIWDAYNVKAQTFKTAIEAACMLLRIDDIVSGIKKKQAPGAGPSKPTIETEGDADNEQILPD

SEQ ID NO: 6496 - protein, 555 aa, Medicago truncatula
MQSSVLVLKDSLKRESGPKVHHANIQASKAVADIIRTTLGPRSMLKMLLDASGGIVVTNDGNAILRELDIAHPAAKSMIELSRTQDEEVGDGTTSVIILAGEMLHVAEAFIDKNYHPTVICRAYNKALEDAIAAIDKIAMPIDAQDRGQMLGLVKSCIGTKFTSQFGDLIADLAIDATTTVGVDIGQGLRDVDIKNYIKVEKVPGAQLEDSRVLKGVMFNKDVVAPGKMRRKIVNPRIILLDCPLEYKKGENQTNAELLREEDWSLLLKLEEEYIEELCMQILKFKPDLVVTEKGLSDLACHYLSKHGVSAIRRLRKTDNNRIAKACGAVIVNRPDELQESDVGTGAGLFEVKKIGDEYFAFIVDCKEPKACTVLLRGASKDLLNEVERNLQDAMSVARNIIKNPKLVPGGGATEMTVSAALKQKSSSIEGIEKWPYEAAAIAFESIPRTLAQNCGVNVIRTMTALQGKHANGENAWIGIDGNTGVIADMKERKIWDAYNVKAQTFKTAIEAACMLLRIDDIVSGIKKKQAPGAGPSKPKIDTEGDADGEQILPD

SEQ ID NO: 6497 - protein, 554 aa, Glycine max
MHAPVLVLKDSLKRESGSKVRYAIIQAAEAVADVVRTTLGPRSMLKMLLDAQGGIVVTNDGNAILRELDLAHPAAKSMIELSRTQDEEVGDGTTSVIILAGEMLHVADAFIDKIHPTVICRAYAKALEDAIAVLDKIAMPINAQDRGIMLGLVKSCIGTKFTGRFGDLIADLAIDATTTVGVEVGQGLRDVDIKNYIKVEKVPGGQLEDSRVLKGVMINKDVVAPGKMRRKIVNPRIILLDCPLEYKKGENQTNAELLKEEDWSLLLKMEEEYIEELCMQILKFKPDLVITEKGLSDLACHYLSKHGVSAIRRLRKTDNNRIAKACGAVIVNRPDELQESDVGTGAGLFEVKKIGDEYFAFIVDCKEPKACTVLLRGASKDLLNEVERNLQDAMSVARNIIKNPKLVPGGGATELTVSAALKQKSSSIEGIEKWPYEAAALAFEAIPRTLAQNCGVNVIRTMTALQGKHANGENAWIGIDGNTGSITDMKECKIWDAYNVKAQAFKTAIEAACMLLRIDDIVSGIKKKQAPGATPSKPKVETEADADSEQILPD

SEQ ID NO: 6498 - protein, 557 aa, Solanum lycopersicum
MHAPVLVMQDSMKREQGGKVQRANIQAAKAVADIIRTTLGPRSMLKMLLDAAGGIVVTNDGNAILRELDLAHPAAKSMIELSRTQDEEVGDGTTSVIVLAGEMLHVAEAFIDKKYHPTVICRAYAKALEDAVAVLDKIAMTVDVEDRETMLGLVKSCIGTKFTSQFGDLISDLAIDATRMVGVELGQGLREVDIKKYIKIEKVPGGQLEDSVVLKGVMMNKDVVAPGKMKRKIVNPRIILLDCPLEYKKGENQTNAELLREEDWTVLLKMEEEYIENMCAQILKFKPDVVITEKGLSDLACHYLCKAGVSAIRRLRKTDNNRIAKACGAVIVNRPDELQESDVGTGAGLFEVKKIGDEFFTFIVDCKDPKACTILLRGASKDLLNEVERNLQDAMSVARNIIKCPKLVPGGGATELTVSAMLKQKSSSVEGIEKWPYEAAAIAFEAIPRTLAQNCGVNVIRTMTALQGKHANGENAWIGIDGNTGEITDMKERKIWDSYAVKAQAFKTAIEAACLLLRIDDIVSGIKKKQAPGAGQGPSKPKIDEEGDADNDQLIPE

SEQ ID NO: 6499 - protein, 257 aa, Taraxacum officinale
MQSPVLVLKDSLTRESGSKVHHANIQASKAVADIIRTTLGPRSMLKMLLDAAGGIVVTNDGNAILRELDIAHPAAKSMIELSRTQDEEVGDGTTSVIVLAGEMLHVAEAFIDKKYHPTVICRAYNKALEDALAVLDKISMSIDVNDRSMMLGLVKSCIGTKFTSQFGDLIADLALDATTTVGVDLGQGIKEVDIKKYIKVEKIPGGQLEDSKVLKGVMFNKDVVVPGKMKRKIINPRIILLDCPLEYKRAKTKQMLN

SEQ ID NO: 6500 - protein, 555 aa, Phaseolus coccineus
MHAPVLVLQDSLKRESGSKVRYAVIQAAKAVADVVRTTLGPRSMLKMLLDAQGGIVVTNDGNAILRELDLAHPAAKSMIELSRTQDQEVGDGTTSVIILAGEMLHVADAFINKIHPTVICRAYTKALEDALSVLDKIAMPIDAQDRGIMLGLVKSCIGTKFTGQFGDLIADLAIDATTTVGVDIGQGLRDVDIKNYIKVEKVPGGQLEDSRVLKGVMINKDVVAPGKMRRKIVNPRIILLDSPLEYKKGENQTNAELLKEEDWSLLLKMEEEYIEELCMQILKFKPDLVITEKGLSDLACHYLSKHGVSAIRRLRKTDNNRIAKACGAVIVNRPDELQESDVGTGAGLFEVKKIGDEYFSFIVDCKDPKACTILLRGASKDLLNEVERNLQDAMSVARNIIKNPKLVPGGGATELTVSAALKQKSSSIEGIEKWPYEAAAIAFESIPRTLAQNCGVNVIRTMTALQGKHANGENTWIGIDGNTGSITDMKEGKIWDAYNVKAQAFKTAIEAACMLLRIDDIVSGIKKKQAPGASGSSKPKIETEADADNEQILPD

SEQ ID NO: 6501 - protein, 556 aa, Helianthus annuus
MQSPVLVLKDSLTRESGNKVHHANIQASKAVADIIRTTLGPRSMLKMLLDAQGGIVVTNDGNAILRELDVAHPAAKSMIELIRTHDEEVGDGTTSIIVLAGEMLHVAKAFIDKKYHPTVICRAYTKALEDALALLDKISMSIDVNDRSMMLGLVKSCIGTKFTSQFGDLIADLALDATTTVGVDLGQGILEVDIKKYIKVEKIPGGQLEDSKVLKGVMFNKDVVVPGKMKRKIINPRIILLDCPLEYKKGENQTNAELVREEDWAVLLKMEEEYIENICVQILKFKPDLVITEKGLSDLACHYFSKAGVSALRRLRKTDNNRIAKACGAVIVNRPDELQESDVGTGAGLFEVKKIGDEFFSFIVDCKDPKACTIFLRGASKDLLNEVERNLQDAMSVARNILKHPKLVPGGGATELTVSATLKQKSSSIEGIEKWPYEAAAVAFEAIPRTLAQNCGVNVIRTMTALQGKHANGENAWTGIDGNSGEIADMKELKIWDAYNVKAQTFKTAIEAASMLLRIDDIVSGIKKRQAPGSNQPSKPTIETEGDADNEQMIPE

SEQ ID NO: 6502 - protein, 555 aa, Eutrema halophilum
MNAPVLVLKDSLKRESGTKVHHGNIQASKAVADIIRTTLGPRSMLKMLLDAGGGIVVTNDGNAILRELDVAHPAAKSMIELSRTQDEEVGDGTTSVIVLAGEMLHVAEAFIEKSYHPTVICRAYNKALEDALAILDKIAMSIDINDRATVLGLVKSCIGTKFTSQFGDLIADLAIDATTTIGVDLGQGLREVDIKKYIKVEKVPGGQLEDSKVLKGVMFNKDVVAPGKMKRKIVNPRIILLDCPLEYKKGENQTNAELVREEDWEVLLKLEEEYIENICVQILKFKPDLVITEKGLSDLACHYFSKAGVSAIRRLRKTDNNRIAKACGAVIVNRPDELQESDVGTGAGLFEVKKIGDDFFAFIVECKEPKACTVLLRGPSKDLLNEVERNLQDAMSVSRNIIKNPKLVPGGGATELTVSATLKQKSATIEGIEKWPYEAAAIAFEAIPRTLAQNCGVNVIRTMTALQGKHANGENAWTGINGNTGAIADMKESKIWDAYNVKAQTFKTAIEAACMLLRIDDIVSGIKKKQAPGAGPSKPTIETEGDADNEQILPD

SEQ ID NO: 6503 - protein, 188 aa, Raphanus sativus
  misc_feature (148)..(148): Xaa can be any naturally occurring amino acid
MNAPVLVLKDSLKRESGTKVHHGNIQASKAVADIIRTTLGPRSMLKMLLDAGGGIVVTNDGNAILRELDVAHPAAKSMIELSRTQDEEVGDGTTSVIVLAGEMLHVAEAFIEKSYHPTVICRAYNKALEDAIAVLDKIAMTIDVNDRXTVLGLVKSCIGTKFTSQFGDLIADLAIDATTTVGVDLGQD

SEQ ID NO: 6504 - protein, 555 aa, Brassica rapa
MNAPVLVLKDSLKRESGTKVHHGNIQASKVVADVIRTTLGPRSMLKMLLDAGGGIIVTNDGNAILRELDVAHPAAKSMIELSRTQDEEVGDGTTSVIVLAGEMLHVAEAFIEKSYHPTVICRAYIKALEDAIAVLDKIAMSIDVNDRETVLGLVKSCIGTKFTSQFGDLIADLAIDATTIVGVDLGQGLREVDIKKYIKVEKVPGGQLEDSKVLRGVMFNKDVVAPGKMKRKIVNPRIILLDCPLEYKKGENQTNAELVREEDWEVLLKLEEEYIENICVQILKFKPDLVITEKGLSDLACHYFSKAGVSAIRRLRKTDNNRIAKACGAVIVNRPDELQESDVGTGAGLFEVKKIGDDFFAFVVDCKEPKACTVLLRGPSKDLLNEVERNLQDAMSVSRNIIKNPKLVPGGGATELTVSATLKQKSATIEGIEKWPYEAAAIAFEAIPRTLAQNCGVNVIRTMTALQGKHANGENAWTGIDGNTGAIADMKESKIWDAYNVKAQTFKTAIEAACMLLRIDDIVSGIKKKQAPGAGPSKPTIETEGDADNEQILPD

SEQ ID NO: 6505 - protein, 555 aa, Cicer arietinum
MQSPVLVLKDSLKRESGAKVHHANIQASKAVADIIRTTLGPRSMLKMLLDASGGIVVTNDGNAILRELDIAHPAAKSMIELSRTQDEEVGDGTTSVIILAGEMLHVAEAFIEKNYHPTVICRAYIKALEDAIAVIDKIAMPIDAQDRGTMLGLVKSCIGTKFTSQFGDLIADLAIDATTTVGVDIGQGLRDVDIKNYIKVEKVPGAQLEDSRVLNGVMINKDVVAPGKMRRKIVNPRIILLDSPLEYKKGENQTNAELLREEDWSLLLKLEEEYIEELCMQILKFKPDLVITEKGLSDLACHYFSKHGVTAIRRLRKTDNNRIAKACGAVIVNRPDELQESDVGTGAGLFEVKKVGDEYFAFIVDCKEPKACTVLLRGASKDLLNEVERNLQDAMSVARNIIKNPKLVPGGGATEMTVSATLKQKSSSIEGIEKWPYEAAAIAFESIPRTLAQNCGVNVIRTMTALQGKHANGENAWTGIDGNTGAIADMQERKIWDAYNVKAQAFKTAIEAACMLLRIDDIVSGIKKKQAPGAGPSKPKIETEGDADGDQILPD

SEQ ID NO: 6506 - protein, 545 aa, Eschscholzia californica
LKRESGSKVQHANIQASKAVADIIRTTLGPRSMLKMLLDASGGIVVTNDGNAILRELDVAHPAAKSMIELSRTQDEEVGDGTTSVIVLAGEMLHVAEAFIDKRYHPTVICRAYNQALEDAIAVLDKIAVSIDVDDRASMLSLVKSCIGTKFTSQFGDLIADLALDATTTVGVDLGQGFREVDVKKYIKVEKIPGGQLEDSHVLKGVMFNKDVVAPGKMRRKIVNPRIILLDCPLEYKKGENQTNAELLKEEDWGVMLKMEEEYIENICAQILKFKPDLVITEKGLSDLACHFFSKAGVSAIRRLRKTDNNRIAKSCGAVIVNRPDELQESDVGTGAGLFEVKKIGDEFFAFVVDCKDPKACTILLRGASKDLLNEVERNLQDAMSVARNILKNPKLVPGGGASELTVSATLKQKSSSVEGIEKWPYEAAALAFEAIPRTLAQNCGVNVIRTMTALQGKHANGENPWIGIDGNTGAIVDMKERKIWDSYNVKAQTFKTAIEASCMLLRIDDIVSGIKKKQPQGSSQAPKPQIEGAEDADNEQMIPE

SEQ ID NO: 6507 - protein, 556 aa, Papaver somniferum
MQAPVLVLKDNLKRESGKKVQHQNIAASKAVADIIRTTLGPRSMLKMLLDASGGIVVTNDGNAILRELDLAHPAAKSMIELSRTQDEEVGDGTTSVIVLTGEMLHVAEAFLDKGYHPTVICRAYNQALEDAILVLEKISMPIDVNDRPSMLGLVKSCIGTKFTSQFGDLIADLAIDATTIVGVDLGQGVREVDIKKYIKVEKIPGGQLEDSKVLEGVMFNKDVVAPGKMKRKIVNPRIILLDCPLEYKKGENQTNAELVKEEDWGIMLKMEEEFIEGLCAQILKFKPDLVITEKGLSDLACHFFSKAGVSAIRRLRKTDNNRIAKACGAVIVNRPDELQESDVGTGAGLFEVKKIGDEFFSFIVDCKDPKACTVLLRGASKDLLNEVERNLQDAMGVARNILKNPKLVPGGGATELTVSATLKQKSSSIAGMEKWPYEAAAIAFEAIPRTLAQNCGVNVIRTMTALQGKHANGENPWVGIDGNTGAIVDMGEKKIWDAYNVKAQTFKTAIEAACMLLRIDDIVSGIKKKQPPGASQAPRSQIEDGDNADNEQMIPE

SEQ ID NO: 6508 - protein, 556 aa, Papaver somniferum
MQAPVLVLKDNLKRESGKKVQHQNIAASKAVADIIRTTLGPRSMLKMLLDASGGIVVTNDGNAILRELDLAHPAAKSMIELSRTQDEEVGDGTTSVIVLTGEMLHVAEAFLDKGYHPTVICRAYNQALEDAILVLEKISMPIDVNDRPSMLGLVKSCIGTKFTSQFGDLIADLAIDATTTVGVDLGQGVREVDIKKYIKVEKIPGGQLEDSKVLEGVMFNKDVVAPGKMKRKIVNPRIILLDCPLEYKKGENQTNAELVKEEDWGIMLKMEEEFIEGLCAQILKFKPDLVITEKGLSDLACHFFSKAGVSAIRRLRKTDNNRIAKACGAVIVNRPDELQESDVGTGAGLFEVKKIGDEFFSFVVDCKDPKACTVLLRGASKDLLNEVERNLQDAMGVARNILKNPKLVPGGGATELTVSATLKQKSSSIEGIEKWPYEAAAIAFEAIPRTLAQNCGVNVIRTMTALQGKHANGENPWIGIDGNTGAIVDMGEKKIWDAYNVKAQTFKTAIEAACMLLRIDDIVSGIKKKQPPGASQAPRSQIEDGDNADNEQMIPE

SEQ ID NO: 6509 - protein, 555 aa, Eutrema parvulum
MHAPVLVLNDSLKRESGTKVHHANIQASKAVADILRTTLGPRSMLKMLLDAGGGIVVTNDGNAILRELDVAHPAAKSMIELSRTQDEEVGDGTTSVIVLAGEMLHVAEAFIEKSYHPTVICRAYIKALEDSIAVLDKIAMTIDVNDRATVLGLVKSCVGTKFTSQFGDLIADLAIDATTTVGVDLGQGLREVDIKKYIKVEKVPGGQLEDSKVLKGVMFNKDVIAPGKMKRKIVNPRIILLDCPLEYKKGENQTNAELVREEDWEVLLKLEEEYIENICVQILKFKPDLVITEKGLSDLACHYFSKAGVSAIRRLRKTDNNRIAKACGAVIVNRPDELQESDIGTGAGLFEVKKIGDDFFAFVVDCKEPKACTVLLRGPSKDLLNEVERNLQDAMSVARNIIKNPKLVPGGGATELTVSATLKQKSATIEGIEKWPYEAAAIAFEVIPRTLAQNCGVNVIRTMTALQGKHANGENAWTGIDGNSGAIADMKESKIWDAYNVKAQTFKTAIEAACMLLRIDDIVSGIKKKQAPGAGPSKPTIETEGDADNEQILPD

SEQ ID NO: 6510 - protein, 241 aa, Chelidonium majus
MQSQVLVLKDSLKRESGSKVQHANIQASKAVADIIRTTLGPRSMLKMLLDASGGIVVTNDGNAILRELDIAHPAAKSMIELSRTQDEEVGDGTTSVIVLAGEMLHVAEAFIDKHYTPQSFAELTAKLLRMLLLCLTKIAVPIDVDDRASMLGLVKSCIGTKFTSQFGDLIADLAIDATTTVGVDLGHGVREVDIKKYIKVEKIPGGPLEDSKVLTGVMFNKDVVAPGKMRRKILNPRHYSS

SEQ ID NO: 6511 - protein, 546 aa, Eutrema parvulum
DSLKRESGTKVHHGNIQASKAVADIIRTTLGPRSMLKMLLDAGGGIVVTNDGNAILRELDVAHPAAKSMIELSRTQDEEVGDGTTSVIVLAGEMLHVAEAFIEKSYHPTVICRAYNKALEDAIAVLDKIAMSIDVNDRATVLGLVKSCIGTKFTSQFGDLIADLAIDATTTVGVDLGQGLREVDIKKYIKVEKVPGGQLEDSKVLKGVMFNKDVVAPGKMKRKIVNPRIILLDCPLEYKKGENQTNAELVREEDWEVLLKLEEEYIENICVQILKFKPDLVITEKGLSDLACHYFSKAGVSAIRRLRKTDNNRIAKACGAVIVNRPDELQESDVGTGAGLFEVKKIGDDFFAFIVDCKEPKACTVLLRGPSKDLLNEVERNLQDAMSVSRNIIKNPKLVPGGGATELTVSATLKQKSATIEGIEKWPYEAAAIAFEAIPRTLAQNCGVNVIRTMTALQGKHANGENAWTGIDGNTGAIADMKESKIWDAYNVKAQTFKTAIEAACMLLRIDDIVSGIKKKQAPGAGPSKPTIETEGDADNEQILPD

SEQ ID NO: 6512 - protein, 570 aa, Actinidia deliciosa
  misc_feature (220)..(220): Xaa can be any naturally occurring amino acid
  misc_feature (558)..(558): Xaa can be any naturally occurring amino acid
  misc_feature (560)..(560): Xaa can be any naturally occurring amino acid
  misc_feature (563)..(563): Xaa can be any naturally occurring amino acid
  misc_feature (565)..(565): Xaa can be any naturally occurring amino acid
MHAPVVVLKDSLNRESGSRVHHANIQASKAVADIIRTTLGPRSMLKMLLDAAGGIVVTNDGNAILRELDLAHPAAKSMIELSRTQDEEVGDGTTSVIVLAGEMLHVAEAFIDKKYHPTVICRAYNKALEDALAVLDKIAMPIDVTDRVTMLGLVKSCIGTKFTSQFGDLIADLAIDATTTVGVDLGQGLREVDIKKYIKVEKVPGGQLEDSKVLKGVMFXKDVVAPGKMRRKIVNPRIILLDCPLEYKKGENQTNAELVKEEDWGVLLKMEEEYIENLCMQILKFKPDLVITEKGLSDLACHYFSKAGVSAIRRLRKTDNNRIAKACGAVIVNRPDELQESDVGTGAGLFEVKKIGDEFFAFIVECKDPKACTVLLRGASKDLLNEVERNLQDAMSVARNIIKNPKLLPGGGATELTVSATLKQKSQSIEGIEKWPYEAAAIAFEAIPRTLAQNCGVNVIRTMTALQGKHANGENAWTGIDGNTGKISDMNEAKIWDAYNVKAQTFKTAIEAASMLLRIDDIVSGIKKKQAPGASKGPSKPTIDQEGDADGEQIIPEXKXPGXLXNQRSL

SEQ ID NO: 6513 - protein, 547 aa, Solanum phureja
EDSMKREQGGKVQRANIQAAKAVADIIRTTLGPRSMLKMLLDAAGGIVVTNDGNAILRELDLAHPAAKSMIELSRTQDEEVGDGTTSVIVLAGEMLHVAEAFIDKKYHPTVICRAYAKALEDAVAVLDKIAMTVDVEDRETMLGLVKSCIGTKFTSQFGDLIADLAIDATRMVGVELGQGLREVDIKKYIKVEKVPGGQLEDSVVLKGVMMNKDVVAPGKMKRKIVNPRIILLDCPLEYKKGENQTNAEILREEDWTVLLKMEEEYIENICAQILKFKPDVVITEKGLSDLACHYLCKAGVSAIRRLRKTDNNRIAKACGAVIVNRPDELQESDVGTGAGLFEVKKIGDEFFTFIVDCKDPKACTILLRGASKDLLNEVERNLQDAMSVARNIIKCPKLVPGGGATELTVSAMLKQKSSSVEGIEKWPYEAAAIAFEAIPRTLAQNCGVNVIRTMTALQGKHANGENAWIGIDGNTGEITDMKERKIWDSYAVKAQAFKTAIEAACLLLRIDDIVSGIKKKQAPGAGPSKPKIDEEGDADNDQLIPE

SEQ ID NO: 6514 - protein, 512 aa, Brassica oleracea
  misc_feature (44)..(44): Xaa can be any naturally occurring amino acid
  misc_feature (87)..(87): Xaa can be any naturally occurring amino acid
  misc_feature (90)..(92): Xaa can be any naturally occurring amino acid
  misc_feature (98)..(98): Xaa can be any naturally occurring amino acid
  misc_feature (243)..(243): Xaa can be any naturally occurring amino acid
MLKMLLDAGGGIVVTNDGNAILRELDVAHPAAKSMIELSRTQDXEVGDGTTSVIVLAGEMLHVAEAFIEKSYHPTVICRAYNKALEXAIXXXDKIAMXVDVNDRATVLGLVKSCIGTKFTSQFGDLIADLAIDATTTVGVDLGQGLREVDIKKYIKVEKVPGGQLEDSKVLKGVMFNKDVVAPGKMKRKIVNPRIILLDCPLEYKKGENQTNAELVREEDWEVLLKLEEEYIENICVQILKFXPDLVITEKGLSDLACHYFSKAGVSAIRRLRKTDNNRIAKACGAVIVNRPDELQESDVGTGAGLFEVKKIGDDFFAFVVDCKEPKACTVLLRGPSKDLLNEVERNLQDAMSVSRNIIKNPKLVPGGGATELTVSATLKQKSATIEGIEKWPYEAAAIAFEAIPRTLAQNCGVNVIRTMTALQGKHANGENAWTGIDGNTGAIADMKESKIWDAYNVKAQTFKTAIEAACMLLRIDDIVSGIKKKQAPGAGPSKPTIETEGDADNEQILPD

SEQ ID NO: 6515 - protein, 548 aa, Vinca minor
DSLKRESGNKVHYGNIQASKAVADIIRTTLGPRSMLKMLLDAAGGIVVTNDGNAILRELDLAHPAAKSMIELSRTQDEEVGDGTTSVIILAGEMLHVAEAFIGRNYHPTVICRAYNKALEDAIAVLDKISMSIDVKDRAATLDLVKSCIGTKFTSQFGDLIADLAIDATSTVGVELEPSLREVDIKKYIKVEKVPGGQLEDSKVLKGVMINKDVVAPGKMRRRIVNPRIVLLDCPLEYKKGENQTNAELMREEDWSVLLKMEEEYIDNLCAQILKFKPDLVITEKGLSDLACHYLSKAGVSAIRRIRKTDNNRVAKACGAVIVNRPDELQESDVGTRAGLFEVRKIGDEFFSFIVDCNDPKACTVLLRGASKDLLNEVERNLQDAMSVARNIIKNPKLVPGGGATELTVSAMLKQKSSSVEGIEKWPYEAAAIAFEAIPRTLAQNCGVNVIRTMTALQGKHANGENAWIGIDGNTGEITDMKERKIWDSYTVKAQAFKTAIEAACMLLRIDDIVSGIKKKQAPGAGSASSKPTVNEEGEADNEALIPE

SEQ ID NO: 6516 - protein, 603 aa, Secale cereale
HLKAQTEQTLELERSRGAAASAFPFSSPSSHLAAASPSSRLSPDRHGIARPVLVLKDSLKRESGAKVQHGNIQAAKAVSDIIRTTLGPRSMLKMLLDASGGIVVTNDGNAILRELDIAHPAAKSMIELSRTQDEEVGDGTTSVIVLAGEMLHVAETFIEKNYHPTVICRAYSRALEDAIAVLDKIAMPVDVNDREAMLGLVKSSIGTKFTGQFGDLIADLAIDATTTAGVDLGQGMREVDIKKYIKIEKIPGGQLEDSKVLKGVMFNKDVVAPGKMKRKIVNPRIILLDCPVEYKKGENQTNAELMSEEDWKVLLDMEEEYIKNLCVQILKFKPDLVITEKGLSDMAMHYLSKAGVSAIRRLRKTDNNRIAKACGAVIVNRPEELQESDVGTRAGLFEVKKIGDEFFSFIIECKDPKACTVLLRGASKDILNEVERNLQDAMSVARNILKNPKLLPGGGASELTVSATLKQKSSSVEGVEKWPYEAAALAFEAIPRTLLQNCGLNVIRTMTQLQGKHANGENPWVGVDGRTGDIVDMKERKIWDSYSVKAQTFKTAIESACMLLRIDDIVSGIKKKQAPGSGAPKQPQIETGEDADTEQMIPE

SEQ ID NO: 6517 - protein, 478 aa, Aquilegia formosa
MIELSRTQDEEVGDGTTSVIVLAGEMLHVAEAFINKRYHPTVICRAYSKALEDSIEVLDKIAMPINVKERAEMLGLVKSCIGTKFTSQFGDLIANLALDATTIVGVDHGHGLREVDIKKYIKVEKVPGGQLEDSKVLKGVMFNKDVVAPGKMRRKILNPRIILLDSPIEYKKGENQTNAELVKEEDWGVLLKLEEEYIENLCVQILKFKPDVVITEKGLSDLACHYFSKAGVSAIRRLRKTDNNRIARACGAVVVNRPEELQESDVGKGAGLFEVKKIGDEFFAFIVDCEAPKACTVLLRGASKDLLNEVERNLQDAMSVARNIIKNPKLVPGGGATELTVSATLKQKSSSIEGIEKWPYEAAALAFEAIPRTLAQNCGVNVIRTMTALQGKHANGENAWVGIDGNTGVIADMKERKIWDSYSVKAQTFKTAIEAACMLLRIDDIVSGIKKKQAPGAGPSKPQIETGEDADNEQMIPE

SEQ ID NO: 6518 - protein, 375 aa, Abies balsamea
MHAPVLVLNDAVKRETGNRVHHANIQASKAVADIIRTTLGPRSMLKMLLDASGGIVVTNDGNAILRELDLAHPAAKSMIELSRTQDEEVGDGTTSVIVLAGEMLHVAEAFIDKAFHPTVICRAYSKALEDAIAVLDKIAIPIDVNDRPTLLKMVKSCIGTKFTGQFGDLIADMAIDATTTVGVDIGNGLREVDIKKYVKVEKVPGGQLEDSKVLKGVMFNKDVVAPGKMRRKIVNPRIILLDCPLEYKKGENMTNAELIREEDWGLLLKMEEEYIEKICMQILCFKPDLVITEKGLSDLAAHYLSKAGVSAIRRLRKTDNNRIAKACGATVVNRPEELQESDVGTGAGLFEVKRLGMSILLILLSARIQKLAQFF

SEQ ID NO: 6519 - protein, 542 aa, Ambrosia trifida
MQSPVLVLKDSLTRESGSKVHHANIQASKAVADIIRTTLGPRSMLKMLLDAQGGIVVTNDGNAILRELDIAHPAAKSMIELSRTQDEEVGDGTTSVIVLAGEMLHVAEAFIDKKYHPTVICRAYNKALEDALAVLDQISMSIDVNDRSMMLGLVKSCIGTKFTSQFGDLIADLALDATTTVGVDLGQGIREVDIKKYIKVEKIPGGQLEDSKVLKGVMFNKDVVVPGKMKRKIINPRIILLDCPLEYKKGENQTNAELVREEDWAVLLKMEEEYIENLCVQILKFKPDLVITEKGLSDLACHYFSKAGVSAIRRLRKTDNNRIAKACGAVIVNRPDELQESDIGTGAGLFEVKKIGDEFFSFIVDCKDPKACTVLLRGASKDLLNEVERNLQDAMSVARNILKHPKLVPGGGATELTVSATLKQKSSSIEGIEKWPYEAAAVAFEAIPRTLAQNCGVNVIRTMTALQGKHANGENAWTGIDGNSGEIADMKELKIWDAYNVKAQTFKTAIEAACMLLRIDDIVSGIKKRQAPGSNQPSKPTN

SEQ ID NO: 6520 - protein, 556 aa, Pseudotsuga menziesii
MHAPVLVLNDAVKRETGNRVHHGNIQASKAVADIIRTTLGPRSMLKMLLDASGGIVVTNDGNAILRELDLAHPAAKSMIELSRTQDEEVGDGTTSVIVLAGEMLHVAEAFIDKAFHPTVICRAYSKALEDAIAVLDKIAIPIDVNDRPTMLKMVKSCIGTKFTGQFGDLIADMAIDATTTVGVDLGNGLREVDIKKYIKVEKVPGGQLEDSKVLRGVMFNKDVVAPGKMRRKIVNPRIILLDCPLEYKKGENMTNAELIREEDWGVLLKMEEDYIEKICMQILCYKPDLVITEKGLSDLAAHYLSKAGVSAIRRLRKTDNNRIAKACGATVVNRPEELQESDVGTGAGLFEVQKIGDEYFTYIVECKDPKACTVLLRGASKDLLNEVERNLQDAMSVARNMIKNPKLVPGGGATELTVSATLKQKSSSVEGIDKWPYEAVALAFEAIPRTLAQNCGVNVIRTMTALQAKHANGENVWTGIDGNTGAITDMKERGIWDAYNVKAQTFKTAIEAACMLLRIDDIVSGIKKKQAPGGSASAKPQVEDEKDVDSEQMIPE

SEQ ID NO: 6521 - protein, 556 aa, Fragaria vesca
MQSQVLVLKDSVKRETGSKVHHANIQASKAVADIIRTTLGPRSMLKMLLDASGGIVVTNDGNAILRELDLAHPAAKSMIELSRTQDEEVGDGTTSVIILAGEMLHVAETFIDQHFHPTVICRAYNKALEDAIAVLDKIAMTIDVTDRATMLGLIKSCIGTKFTSQFGDLIADLALDATRIVGVDLGQGLREVDIKKYIKVEKVPGGQLEDSVVLKGVMINKDVIAPGKMRRKIVNPRIMLLDCPLEYKKGENQTNAELLKEEDWGLLLKLEEEYIEGLCVQILKFKPDVVITEKGLSDLACHYLSKAGVTAIRRLRKTDNNRIAKACGAVIVNRPDELQDSDIGTGAGLFEVKKIGDEYFTFIVDCKDPKACTVLLRGPSKDMLNEVERNLQDAMSVARNILKNPKLVPGGGASELTVSATLKQKSSSIEGIEKWPYEAAALAFEAIPRTLAQNCGVNVIRTMTALQGKHANGENAWIGIDGNTGAMTDVKEKKIWDAYNVKAQTFKTAIESACLLLRIDDIVSGIKKKQPAGSKTPSKPQVETEGDADNEQIIPE

SEQ ID NO: 6522 - protein, 556 aa, Pinus pinaster
MHAPVLVLNDAIKRESGNRVHHANIQASKAVADIIRTTLGPRSMMKMLLDAGGGIVVTNDGNAILRELDLAHPAAKSMIELSRTQDEEVGDGTTSVIVLAGEMLHVAEAFIDKAYHPTVICRAYSKALEDAIAVLDKIAIPIDVNDRPTMLKMVKSCIGTKFTGQFGDLIADMAIDATTTVGVDLGNGLHEVDIKKYVKVEKVPGGQLEDSKVLRGVMINKDVVAPSKMRRKIVNPRIILLDCPLEYKKGENMTNAELIREEDWGVLLKMEEEYIEKICVQILSFKPDLVVTEKGLSDLAAHYFSKAGVSAIRRLRKTDNNRIAKASGATVVNRPEELQESDVGTGAGLFEVQKIGDEYFTFIVDCKDPKACTVLLRGASKDLLNEVERNLQDAMSVARNMIKNPKLVPGGGATELTVSATLKQKSSTVEGIEKWPYEAVALAFEAIPRTLAQNCGVNVIRTMTALQAKHANGENVWTGIDGNTGAITDMKERGIWDAYNVKAQTFKTAIEAACMLLRIDDVVSGIKKKQAPGSSGPTKPQVEDEKDVDSEQMIPE

SEQ ID NO: 6523 - protein, 556 aa, Pinus taeda
MHAPVLVLNDAIKRETGNRVRHANIQASKAVADIIRTTLGPRSMMKMLLDAGGGIVVTNDGNAILRELDLAHPAAKSMIELSRTQDEEVGDGTTSVIVLAGEMLHVAEAFIDKAYHPTVICRAYSKALEDAIAVLDKIAIPIDVNDRPTMLKMVKSCIGTKFTGQFGDLIADMAIDATTTVGVDLGNGLHEVDIKKYIKVEKVPGGQLEDSKVLRGVMINKDVVAPSKMRRKIVNPRIILLDCPLEYKKGENMTNAELIREEDWGVLLKMEEEYIEKICVQILSFKPDLVVTEKGLSDLAAHYFSKAGVSAIRRLRKTDNNRIAKASGATVVNRPEELQESDVGTGAGLFEVQKIGDEYFTFIVDCKDPKACTVLLRGASKDLLNEVERNLQDAMSVARNMIKNPKLVPGGGATELTVSATLKQKSSTVEGIEKWPYEAVALAFEAIPRTLAQNCGVNVIRTMTALQAKHANGENVWTGIDGNTGAITDMKERGIWDAYNVKAQTFKTAIEAACMLLRIDDVVSGIKKKQAPGSSGPTKPQVEDEKDVDSEQMIPE

SEQ ID NO: 6524 - protein, 490 aa, Gossypium raimondii
MHAPVLVLKDSLKRESGTKVHHANIQASKAVADIIRTTLGPRSMLKMLLDASGGIVVTNDGNAILRELDLAHPAAKSMIELSRTQDEEVGDGTTSVIVLAGEMLHVAEAFIEKNYHPTVICRAYNKALEDAIAVLDKIAMSIDVKDRATMLGLVKSCIGTKFTSQFGDLIADLAIDATQTVGVDLGQGLREVDIKKYIKVEKVPGGQLEDSKVLKGVMINKDVVAPGKMKRKIVNPRIILLDCPLEYKKGENQTNAELVKEEDWEVLLKMEEEYIESLCLQILKFKPDLVVTEKGLSDLACHYLSKAGVSAIRRVRKTDNNRIAKASGAVIVNRPDELQESDVGTGAGLFEVKKIGDEFFAFIVDCKDPKACTVLLRGASKDLLNEVERNLQDAMSVARNIIKNPKLVPGGGATELTVSATLKQKSSSVEGIEKWPYEAAALAFEAIPRTLAQNCGVNVIRTMTALQGKVWMLLECCYTLFTIPFTISIY

SEQ ID NO: 6525 - protein, 555 aa, Silene vulgaris
MNSRTIVLNDSTKRESGTKVHHANIRAGKSVADIIRTTLGPRSMLKMLLDAAGGIVVTNDGNAILRELDLAHPAAKSMIELSRTQDEEVGDGTTSVIILAGEMLHVAEDFIDKNYHPTVICRAYTKALEDAVAALDKIAMSIDIKDRDTILGLVKSCIGTKFTSQFGDLIADLAIDATAMVGVDLGQGLREVDIKKYIKVEKIPGGQLEDSQVLRGVMINKDIVTPGKMRRRIVNPRIILLDCPLEYKKGENQTNAEILREEDWETLLRVEEEYIQEICAQILKFKPDVVITEKGLSDLASHYFSKAGVSAIRRLRKTDNNRIAKASGAVIVNRPDELQESDVGTGAGLFEVKKIGDDFFTFIVDCEDPKACTVLLRGASKDLLNEVERNLQDAMCVARNIIKNPKLVPGGGATELTVSATLKQKSGSIEGIEKWPYEAAALAFEAIPRTLAQNCGVNVIRTMTALRGKHANGENAWVGIDGNSGEIADMKEKKIWDSYTVKAQTFKTAIESACMLLRIDDIVSGIKKKQAPGAGPQKPQIEQADDADNEQMIPE

SEQ ID NO: 6526 - protein, 558 aa, Zostera marina
MNAPVVVLSDSVTRESGSKVHHANIQASKAVADVIRTTLGPRSMLKMLLDASGGIVVTNDGNAILRELDVAHPAAKSMIELSRTQDEEVGDGTTSVIILAGEFLHVAEAFINKKYHPTIICRAYVNALEDSISALDKIAMSIDVNDRATMLDLVKSCIGTKFTSQFGDLIADLALDATKIVGVDLGQGLREVDIKKYIKVEKIPGGQLEDSKVLRGVMFNKDVVAPGKMRRKILSPRIILLDCPLEYKKGENQTNAELLREEDWGVLLKMEEEYIENLCMQILKFKPDIVITEKGLSDLACHYFSKAGVSAIRRLRKTDNNRIAKACGAVVVNRPDELQQSDVGTGCGLFEVKKIADEFFAFIVECKDPKACTVLLRGASKDLLNEVERNLQDAMSVSRNILKNPKLVPGGGAAELTVSAALKQKSSSIEGIEKWPYEAAALAFEAIPRTLAQNCGVNVIRTMTALQGKHANGENSWIGIDGSTGDIVDMRERKIWDAYNVKAQTFKTAIEAACMILRIDDIVSGIKKRQAPGSGPPSQSKPKLEDEGDADNEQMIPE

SEQ ID NO: 6527 - protein, 534 aa, Helianthus annuus
MQSPVLVLKDSLTRESGSKVHHANIQASKAVADIIRTTLGPRSMLKMLLDAQGGIVVTNDGNAILRELDIAHPAAKSMIELSRTQDEEVGDGTTSVIVLAGEMLHVAEAFIDKKYHPTVICRAYIKALEDALAVLDKISMSIDVNDRSMMLGLVKSCIGTKFTSQFGDLIADLALDATTTVGVDLGQGIREVDIKKYIKVEKIPGGQLEDSKVLKGVMFNKDVVVPGKMKRKIINPRIILLDCPLEYKKGENQTNAELVREEDWAILLKMEEEYIENICVQILKFKPDLVITEKGLSDLACHYFSKAGVSAIRRLRKTDNNRIAKACGAVIVNRPDELQESDVGTGAGLFEVKKIGDEFFSFIVDCKDPKACTILLRGASKDLLNEVERNLQDAMSVARNILKHPKLVPGGGATELTVSATLKQKSSSIEGIEKWPYEAAAVAFEAIPRTLAQNCGVNVIRTMTALQGKHANGENAWTGIDGNSGEIADMKELKIWDAYNVKAQTFKTAIEAASMLLRIDDIVSGIKKKASSWI

SEQ ID NO: 6528 - protein, 409 aa, Zostera marina
MLDLVKSCIGTKFTSQFGNLIADLALDATKIVGVDLGQGLREVDIKKYIKVEKIPGGQLEDSKVLRGVMFNKDVVAPGKMRRKILNPRIILLDCPLEYKKGENQTNAELLKEEDWGVLLKMEEEYIENLCMQILKFKPDIVVTEKGLSDLACHYFSKAGVSAIRRLRKTDNNRIAKACGAIVVNRPDELQESDVGTGCGLFEVKKIADEFFAFIVECKDPKACTVLLRGASKDLLNEVERNLQDAMSVSRNILKNPKLVPGGGAAELTVSAALKQKSSLIEGIEKWPYEAAALAFEAIPRTLAQNCGVNVIRTMTALQGKHANGENSWVGIDGNTGAIVDMRERKIWDAYNVKVQTFKTAIEAACMILRIDDIVSGIKKRQAPGSGPPSQSKPKVEEEGDADNEQMIPE

SEQ ID NO: 6529 - protein, 383 aa, Arabidopsis lyrata
MPINVNDRATVLGLVKSCIATKFTSKFGDLIADLAIDATTTIGVDLGQGLREVDIKKYIKVEKVPGGQLEDSKVLKGVMFNKDVVAPGKMKRKIVNPQIILLDCPLEYKKGENQTNAELVREEDWEVLLKLEEEYIENICLQILKFKPDLVITEKGLSDLACHYFSKAGVSAIRRLRKTDNNRIAKACGAVIVNRPDELQESDIGTNVGLFEVKKIGDDFFAFIVDCKEPKACTVLLRGPSKDLLNEVERNLQDAMSVSRNIIKNPKLVPGGGATELTVSATLKQKSATIEGIEKWPYEAAAIAFEVIPRTLAQNCGVNVIRTMTTLQGKHANGENAWTGIDGVTGAIADMKEKKIWDAYNVKSQTYANKRLKLRVCFSGLMI

SEQ ID NO: 6530 - protein, 513 aa, Lippia dulcis
MLKMLLDAAGGIVVTNDGNAILRELDVAHPAAKSMIELSRTQDEEVGDGTTSVIVLAGEMLHVAEAFIDKNYHPTVICRAYNKALEDAVAVLDKIAMSVDVNDRASMLGLVKSCIGTKFTSQFGDLIADLAIDATTTVGVDLGHGLREVDIKKYIKIEKVPGGQLEDSKVLKGVMFNKDVVAPGKMRRKIVNPRIILLDCPLEYKKGENQTNAELMEEEDWSVLLKMEEEYIENLCMQILKFKPDLVITEKGLSDLACHYFSKAGVSAIRRLRKTDNNRIAKACGAVIANRPDELQESDVGVGAGLFEVRKIGDEFFAFIVECKDPKACTVLLRGASKDLLNEVERNLQDAMSVARTIIKNPKLVPGGGATELTVSAMLKQKSSSVEGVEKWPYEAAAIAFEAIPRTLAQNCGVNVIRTMTALQGKHGNGENAWIGIDGNTGDITDMKERKIWDSYSVKAQAFKTAIEAACMLLRIDDIVSGIKKKQAPGASAPSKPTIDKEDDADNENMIPE

SEQ ID NO: 6531 - protein, 556 aa, Podocarpus macrophillus
MHAPVLVLNEGVKRETGNKVHHANIQASKAVADIIRTTLGPRSMLKMLLNAEGGIVVTNDGNSILRELDVAHPAAKSMIELSRTQDEEVGDGTTSVIVLAGEMLHVAEAFIDKGYHPTVICRAYSKALEDAIAVLDKIAIPIDVNDRASLLKMVKSCIGTKFTGQFGNLIADLAIDATTTVSIDIGNGLHEVDIKKYVKVEKVPGGELEDCKVLKGVMINKDIVAPGKMRRKIINPRIILLDCPLEYKKGENMTNAELIKEEDWGVLLKMEEEYIEKMCSTILSFKPDLVITEKGLSDLAAHYLSKGGVSAIRRLRKTDNNRIAKACGATIVNRPDELQESDVGTGAGLFEVQKIGDEYFTFIVECKDPKACTVLLRGASKDLLNEVERNLQDAMCVARNMIKNPKLVPGGGATELTVSATLKQKSSSVEGIEKWPYEAVAVAFEAIPRTLTQNCGVNVVRTMTALQAKHANAENVWVGIDGNTGEITDMKERGIWDAYNVKAQTFKTAIEAACMLLRIDDIVSGIKNKQAQGGPKKSKPQVEDGENVDSEQMIPE

SEQ ID NO: 6532 - protein, 556 aa, Sciadopitys verticillata
MHAPVIVLNDSVKRETGSKVHHANIQASKAVADIIRTTLGPRSMLKMLLDASGGIVVTNDGNSILRELDVAHPAAKSMIELSRTQDEEVGDGTTSVIVLAGEMLHVAEAFIDRGYHPTVICRAYSKALEDAIAVLDKIAIPIDVNDRPTLLKMVRSCIGTKFTGQFGNLIADMAIDATTTVSVEIGNGLREVDIKNYVKVEKIPGGQLEDSKVLKGVMFNKDVVAPGKMKRKIINPRIILLDCPLEYKKGENMTNAELIKEDDWSILLKMEEDYIENICSQILSLKPDLVITEKGLSDLAAHYLSKAGVSAIRRLRKTDNNRIARACGATIVNRPEELQESDVGTGAGLFDVQKIGDEYFTFIVDCKEPKACTVLLRGASKDLLNEVERNLQDAMSVSRNMIKNPKLVPGGGATELTVSATLKQKSSSVEGIDKWPYEAVAVAFEAIPRTLTQNCGVNVVRTMTALQAKHANGENVWTGIDGNTGEITDMKERGIWDAYNVKAQTFKTAIEASCMLLRIDDIVSGIKKKQAPGGPTKTKPQTEDGNDVDSEQMIPE

SEQ ID NO: 6533 - protein, 399 aa, Euonymus alatus
SMLKMLLDAAGGIVVTNDGNAILRELDLAHPAAKSMIELSRTQDEEVGDGTTSVIVLAGEMLHVAEAFIDKNYHPTVICRAYNKALEDAIAVLDRIAMSIDVNDRAMMLGMVKSCIGTKFTSQFGDLIADLAIDATTTIGVDLGQGMREVDIKKYIKVEKVPGGQLEDSRVLKGVMFNKDVVAPGKMRRKIVNPRIILLDCPLEYKKGENQTNAELVKEEDWGVLLKMEEEYIENLCVQILKFKPDLVITEKGLSDLACHYLSKAGVSAIRRLRKTDNNRIAKACGAVIVNRPEELQESDVGTGAGLFEVKKIGDEFFAFIVDCKDPKACTILLRGASKDLLNEVERNLQDAMSVARNILKNPKLVPGGGGTELTVSATLKQKSSSIEGIEKCLMKPRQ

SEQ ID NO: 6534 - protein, 421 aa, Cynara scolymus
  misc_feature (382)..(382): Xaa can be any naturally occurring amino acid
MQSPVLVLKDSLTRESGSKVHHANIQASKAVADIIRTTLGPRSMLKMLLDAQGGIVVTNDGNAIWRELDIAHPAAKSMIELSRTQDEEVGDGTTSVIVLAGEMLHVAEAFIDKKYHPTVICRAYNKALEDALAVLDKISMSIDVNDRSMMLGLVKSCIGTKFTSQFGDLIADLALDATTTVGVDIGQGLREVDIKKYIKVEKIPGGQLEDSKVLKGVMFSKDVVVPGKMRRKIVNPRVILLDCPLEYKKGENQTNAELVREEDWAVLLKMEEEYIENLCVQILKFKPDLVITEKGLSDLACHYFSKAGVSAIRRLRKTDNNRIAKACGAVIVNRPDELQESDVGTGAGLFEVKKIGDEFFAYIVDCKDPKACTVLLRGASKXLLNEVERNLQDAMSVARNILKHPKLVPGGGATELTFLQL

SEQ ID NO: 6535 - protein, 344 aa, Flaveria ramosissima
GPRSMLKMLLDAQGGIVVTNDGNAILRELDIAHPAAKSMIELSRTQDEEVGDGTTSVIVLAGEMLHVAEAYIDKKYHPTVICRAYNKALEDALAVLDKISMSIDVNDRSMMLGLVKSCIGTKFTSQFGDLIADLALDATTTVGVDLGQGIREVDIKKYIKVEKIPGGQLEDSKVLKGVMFNKDVVVPGKMKRKIINPRIILLDCPLEYKKGENQTNAELVREEDWAVLLKMEEEYIENICVQILKFKPDLVITEKGLSDLACHYFSKAGVSAIRRLRKTDNNRIAKACGAVIVNRPDELQESDVGTGAGLFELKRLVMNFLHLLWIVKTRKRAPFFSEVPARIF

SEQ ID NO: 6536 - protein, 528 aa, Cajanus cajan
AVADIIRTTLGPRSMLKMIIDAGGGIVVTNDGNAILREVDVAHPAAKSMIELSRIQDEEVGDGTTSVIILAGEMLHVAEALIDKNYHPTVICRAYNKALEDAIAVLDKIAMPIDAKDRGTMLGLVKSCIGTKFTSQFGDLVADLAIDATATVDIDLGQGLRDVDIKNYIKVEKVPGGQLEDSRVLKGVMINKDVVAPGKMKRKIVNPRVILLDCPLEYKKGENQTNAEMLKEDDWSLLLRMEEEYIEELCMQILKFKPDLVITEKGLSDLACHFLSKHGVSAIRRLRKTDNNRIAKACGAVIVNRPDELQESDVGTGAGLFEVKKIGDEFFAFIVECKDPKACTVLLRGASKDLLNEVERNLQDAMSVARNIIKNPKLVPGGGASELTVSATLKQNSSSVQGIEKWPYEAAAIAFEAIPRTLAQNCGVNVIRTMTSLQGKHANGENAWIGINGNTGDIADMKECKIWDAYNVKAQTFKTAIEAACMLLRIDDVVSGIKKRQAPGAGQAPSKPKVETEADADSEQILPD

SEQ ID NO: 6537 - protein, 539 aa, Distylium racemosum
MHSPVLVLNESVKRESGSKVHHANIQASKAVADIIRTTLGPRSMLKMLLDAAGGIVVTNDGNSILRELDVAHPAAKSMIELSRTQDEEVGDGTTSVIVLAGEMLHVAEAFIDKGYHPTVICRAYSKALEDAIAVLDKIAIPIDVNDRSTMLKMVKSCIGTKFTGQFGNLIADLAIDATTTVSIDIGNGLHEVDIKKYVKVEKVPGGELEDSKVLKGVMFNKDVVAPGKMRRRIINPRIILLDCPLEYKKGENMTNAELLREEDWSVLLKMEEEFIEKICSQILSFKPDLVITEKGLSDLAAHYLSKGGVSAIRRLRKTDNNRIAKACGATIVNRPEELQESDVGTGAGLFEVQKIGDEYFTFIVECKDPKACTVLLRGASKDLLNEVERNLQDAMCVARNMIKNPKLVPGGGAAELTVSATLKQKSSSVEGIEKWPYEAVAVAFEAIPRTLTQNCGVNVVRTMTALQAKHANGENVWIGIDGNTGEITDMKERGIWDAYNVKAQTFKTAIEASSMLLRIDDIVSGIKKKQAQGGPTKAK

SEQ ID NO: 6538 - protein, 377 aa, Sorghum bicolor
MPPPSAAATSTTAAASAARDDMSPAEARLAMMELANMVSVPMALTAVIRLGVPAAIWAGGANAPRSAAELLPAGHPDPSVLERLLRLLASRGVFSESTSTSEDRTTTTRRFALTAVGRTLVPEGASGASYADYVLQHHQDALVAAWPRLHEAVLDPRGPEPFARANAGVPAYAYYGKDREANQVMLRAMTGVSEPFMHALLDGYGFDGGFHGVATLVDVGGSSGACLEMIMRRVPTIKEGINFDLPDVVADAPAIAGVRHVGGDMFKSIPSGDAIFMKWVLTTWTNDECTAILRNCHAALPDGGKLVACEPVVPEETDSSTRTRALLENDIFVMTTYRTQGRERSEEEFHHLGIAAGFTGFRAIYLDPFYAVLEYTK

SEQ ID NO: 6539 - protein, 360 aa, Saccharum officinarum
MPPPSAVDMSPAEARLAMMELANMVSVPMALTAVIRLGVPDAIWAGGANAPRSAAELLPVGHPDPSVLERLLRLLASRGVFSESTSTSEDPTTTRRFALTAVGRTLVPEGASGASYADYVLQHHQDALVAAWPRLHEAVLDPRGPEPFARANAGVPAYAYYGKDREANQVMLRAMTGVSEPFMEALLEGYGGFRGVATLVEVGGSSGACLEMIMRRVPNIKEGINFDLPDVVADAPPIAGVRHVGGDMFKSIPSGDAIFMKWVLTTWTNDECTTILRNCHGALRDGGKLVACEPVVPEQTDTSTRTRALLENDIFVMTTYRTQGRERSEVEFRHLGVTAGFTAFRAIYLDPFYAVLEYTK

SEQ ID NO: 6540 - protein, 368 aa, Triticum aestivum
MSSPQPPAAEPATPTAAEMSPPEARLAMMELANMIAVPMALTAVIRLGVPAAVWAGGANAPLSAAELLPPGHPDPSVLERLLRLLASRGVFSEHAADGRPERRYALTAVGRTLVPSGASGASYADYVLQHHQDALVLAWPRLHEAVLDPAGPEPFARAHAGVPAYAYYGQDRAANEVMLRAMTGVSEPFMEALLDGYEGGFEGVATLVDVGGSSGACLEMIMRRVPTIREGVNFDLPDVVAAAPPIAGVKHVGGDMFKSIPSGDAIFMKWVLTTWTNDECTAILKKCHEALPEGGKLIACEPVVPETTDASTRTRALLENDIFVMTTYRTQGRERSEEEFRQLGLTAGFAGFRALYLDPFYAVLEYVK

SEQ ID NO: 6541 - protein, 366 aa, Pseudoroegneria spicata
MSSPPAAEPATAAAAEMSPPEARLAMMELANMIAVPMALTAVIRLGVPAAVWAGGANTPLSAAELLPPGHPDPSVLERLLRLLTSRGVFSEHADAAAGRRRYALTAVGRTLVPSGPSGASYADYVLQHHQDALVLAWPRLHEAVRDPAGPEPFARAHAGVPAYAYYGQDRGANEVMLRAMTGVSEPFMEALLDGYEGGFEGVATLVDVGGSSGACLEMIMRRVPTIREGVNFDLPDVVAAAPPIAGVKHVGGDMFKSIPSGDAIFMKWVLTTWTNDECTAILKKCHEALPEGGKLIACEPVVPETTDASTRTRALLENDIFVMTTYRTQGRERSEEEFRQLGLTAGFAGFRALYLDPFYAVLEYVK

SEQ ID NO: 6542 - protein, 385 aa, Setaria italica
PPLARWLAAHHHSNSNFHLVPSPRSLTKCCPPPPSAEARLAMMELANMISVPMALTAVIRLGVPSAVWAGGANAPLSAAELLPEGHPDPSVLERLLRLLASRGVFSEHGGGSAGSPRRFALTAVGRTLVPSGPSGASYADYVLQHHQDALVSAWPRLHEAVLDPAGPEPFARANAGVPAYAYYGRDREANEVMLRAMTGVSEPFMEALLDGYAAGFEGVATLVDVGGSSGACLEMIMRRVDTIREGINFDLPDVVAAAPPIVGVRHVGGDMFKSIPSGDAIFMKWVLTTWTNEECTAILGNCYSALPDGGKVIACEPVVPEETDGSTRTRALLENDIFVMTTYRTQGRERSEDEFRNLGIAAGFTGFRAIYLDPLYAVLEYTKNK

SEQ ID NO: 6543 - protein, 299 aa, Panicum virgatum
AEARLAMMELANMISVPMALTAIIRLGVPSAVWAGGANAPLSAAELLPEGHPDPSVLERLLRLLASRGVFSEHGGSPRRFALTAVGRTLVPGPTGASYADYVLQHHQDALVAAWPRLHEAVLDPAGPEPFARANAGVPAYAYYGKDREANQVMLRAMTGVSEPFMDALLDGYAQGFHGVATLVDVGGSSGACLQMIMRRVATITEGINFDLPDVVAAAPPIAGVRHVGGDMFKSIPSGDAIFMKWVLTTWTNDECTAILRNCTARCRPAARSSPASRWCRKRRTPAPGPGPCSRTTSSS

SEQ ID NO: 6544 - protein, 372 aa, Secale cereale
PPEARLAMMELANMIAVPMALTAVIRLGVPAAVWAGGANAPLSAAELLPPGHPDPSVLERLLRLLASRGVFSEHAADPSGGRERRYALTARGAHPGALGPLRRVVRRLRAAAPPGRAGAGVAAPPRGRARPGRPGALRARPRRRARLRLLRPGPGRQRGDAPRHDRRVGAVHGGAAGRVLPGRRVRGRGHAGRRRRQLRRLPGDDHAPGAHHPRGRQLRPARRRRGRAPHRRSEACGWRHVQVHPLRRRHLHEVGSHDVDQRRVHSDPQEMPRGAAGGREAHRVRAGGAGDDGRLHEDEGAAGERHLRHDHLPDPGEGAVRGGVPAARPHRRLHRLPGPLPRPFLRRPRVCQVTGDLDLTSPPNCFLPCIRN

SEQ ID NO: 6545 - protein, 350 aa, Secale cereale
EARLAMMELANMIAIPMALTAVIRLGVPAAVWAGGANAPLSAAELLPPGHPDPSVLERLLRLLASRGVFSEHAADPSGGRERRYALTAVGRTLVPSGPSGASYADYVLQHHQDALVLAWPRLHEAVLDPAGPEPFARAHAGVPAYAYYGQDRDANEVMLRAMTGVSEPFMEALLDGYCPGGGFEGVATLVDVGGSSGACLEMIMRRVPTIREGVNFDLPDVVAAAAPIAGVKHVGGDMFKSIPSGDAIFMKWVLTTWTNDECTAILKKCHEALPEGGKLIACEPVVPETTDASTRTRALLENDIFVMTTYRTQGRERSEEEFRQLGLTAGFTGFRALYLDPFYAVLEYVK

SEQ ID NO: 6546 - protein, 365 aa, Oryza sativa
MGGGGDGELSPAEARLAMMELANMISVPMALTAVIRLGVPAKLWAGGANAPLAAADLLPAGHPDPSVLERLLRLLASRGVFSEHTGSSSPSPRRFSLTAVGRTLVPGGGGSPSGSGASYADYVLQHHQDALVRAWPLLHEAVLDPSGPEPFARANAGVPAYAYYGKDREANEVMLRAMTGVSEPFMEALLEGYGDGGFEGVSTLVDVGGSSGACLEMIMRRVRTIRDGVNFDLPDVVAAAPPIPGVRHVGGDMFKSIPSGDAIFMKWVLTTWTNEECTAILSNCHKALPGGGKVIACEPVVPDTTDGSTRTRALLENDIFVMATYRTQGRERSEEEFRHLGLAAGFASFRAIYLDPFYAVLEYTK

SEQ ID NO: 6547 - protein, 526 aa, Oryza sativa
MSLRPSERVEVRRNRYKVAVDAEEGRRRREDNMVEIRKSRREESLLKKRREGLQAQAPVPASAATGVDKKLESLPAMIGGVYSDDNNLQLEATTQFRKLLSIERSPPIEEVIQSGVVPRFVQFLTREDFPQLQFEAAWALTNIASGTSENTKVVIDHGAVPIFVKLLGSSSDDVREQAVWALGNVAGDSPKCRDLVLANGALLPLLAQLNEHTKLSMLRNATWTLSNFCRGKPQPSFEQTRPALPALARLIHSNDEEVLTDACWALSYLSDGTNDKIQAVIEAGVCPRLVELLLHPSPSVLIPALRTVGNIVTGDDAQTQCIIDHQALPCLLSLLTQNLKKSIKKEACWTISNITAGNKDQIQAVINAGIIGPLVNLLQTAEFDIKKEAAWAISNATSGGSHDQIKYLVSEGCIKPLCDLLICPDIRIVTVCLEGLENILKVGETDKTLAAGDVNVFSQMIDEAEGLEKIENLQSHDNNEIYEKAVKILEAYWMDEEDDTMGATTVAAPQGATFDFGQGGGAAQFK

SEQ ID NO: 6548 - protein, 527 aa, Helianthus annuus
MSLRPSARTEVRRNRYKVAVDADEGRRRREDNMVEIRKSKREESLQKKRREGIAASQFPLPVQSASASEKKLENLPAMVAGVLSDDNNMQLEATTQFRKLLSIERSPPIEEVIQSGVVPRFVEFLMREDFPQLQFEAAWALTNIASGTSEHTKVVIDHGAVPIFVKLLASPSDDVREQAVWALGNVAGDSPKCRDLVLAQGALSSLLAQLNEHSKLSMLRNATWTLSNFCRGKPQPSFDQTRPALPALQQLIHSNDEEVLTDACWALSYLSDGTNDKIQAVIEANVCPRLIELLNHPSPSVLIPALRTVGNIVTGDDMQTQYIINHQALPCLLNLLTNNHKKSIKKEACWTISNITAGNKEQIQTVIEASIIGPLVLLLQNAEFDIKKEAAWAISNATSGGSHDQIKYLVNQGCIKPLCDLLVCPDPRIVTVCLEGLENILKVGEADKNLGRSGDVNLYAQMIDDAEGLEKIENLQSHDNNEIYEKAVKLLETYWLEEEEDDAMPTGQPGFQLGGDVSVPNGGFNFS

SEQ ID NO: 6549 - protein, 529 aa, Nicotiana benthamiana
MSLRPSARTEVRRNRYKVAVDAEEGRRRREDNMVEIRKSKREESLLKKRREGLQPQQQPFPANLHTSTVEKKLESLPSMVAGVWSNDNNLQLEATTQFRKLLSIERSPPIEEVIQSGVVPRFVEFLMREDFPQLQFEAAWALTNIASGTSDNTRVVIDHGAVPIFVKLLGSPSDDVREQAVWALGNVAGDSPRCRDLVLSNGALIPLLAQLNEHTKLSMLRNATWTLSNFCRGKPQPPFEQVRPALSALQRLVHSNDEEVLTDACWALSYLSDGTNDKIQAVIEAGVCPRLVELLMHPSPSVLIPALRTVGNIVTGDDLQTQCIIEHGALTCLLSLLTHNHKKSIKKEACWTISNITAGNKEQIQAVIEAGLIAPLVNLLQTAEFDIKKEAAWAISNATSGGTHEQIKFLVSQGCIKPLCDLLVCPDPRIVTVCLEGLENILKVGEAEKANTGGINYYAQLTDDAEGLEKIENLQSHDNNEIYEKAVKILETYWLEEEDETLPAGDEAQAGFNFGGNDIQLPSGGFKFG

SEQ ID NO: 6550 - protein, 529 aa, Gossypium hirsutum
MSLRPNSRTEVRRNRYKVAVDAEEGRRRREDNMVEIRKNRREESLQKKRREGLQAQPMPASLHSSAVEKKLENLPAMVAGVWADDSNMQLEATTQFRKLLSIERSPPIDQVIQAGVVPRFIEFLARDDFPQLQFEAAWALTNIASGTSENTKVVIDHGAVPIFVKLLASPSDDVREQAVWALGNVAGDSPRCRDLVLSHGALLPLLAQLNEHVKLSMLRNATWTLSNFCRGKPQPPFDLVKPALPALTHLIHSNDEEVLTDACWALSYLSDGTNDKIQAVIEAGVCGRLVELLMHPSPSVLIPALRTVGNIVTGDDGQTQCIINHQVLPCLLNLLTNNFKKSIKKEACWTISNITAGNKEQIQAVIEANIISPLVHLLQNAEFDIKKEAAWAISNATSGGTHDQIKFLVSQGCIKPLCDLLNCPDPRIVTVCLEGLENILKVGEADKNLGTTGGVNLYAQMIDDAEGLEKIENLQSHDNTEIYEKAVKVLETYWLEEEDETMPPGDASQTGFHFGGGELPVPSGGFNFS

SEQ ID NO: 6551 - protein, 529 aa, Euonymus alatus
MSLRPNARTEVRRNRYKVAVDAEEGRRRREDNMVEIRKNRREESLQKKRREGLQAQQMPASMHSSAVEKKLENLPAMVAGVWSDDKNLQLEATTQFRKLLSIERSPPIVEVIQAGVVPRFVEFLMREDYPQLQFEAAWVLTNIASGTSENTKVVIDHGAVPIFVKLLGSPSDDVREQAVWALGNIAGDSPRCRDLVLGHGALLPLLSQLNEHSKLSMLRNATWTLSNFCRGKPQPPFDQVKPALPALARLIHSNDEEVLTDACWALSYLSDGTNDKIQAVIEAGVCPRLVELLTHPSPSVLVPALRTVGNIVTGDDLQTQCIINHQALPCLLTLLTNNYKKSIKKEACWTISNITAGNKEQIQSVIEAVIIGPLVHLLQNAEFDIKKEAAWAISNATSGGTRDQIKLLVSQGCIKPLCDLLICPDPRIVTVCLEGLENILKAGEADKNLGDTGGVNLYAQLIDDAEGLEKIENLQSHDNTEIYEKSVKILETYWLEEEDETMPHGDAPQGFQFGGSEVPTVPSGGFNFS

SEQ ID NO: 6552 - protein, 528 aa, Gossypium hirsutum
MSLRPSTRTEVRRNRYKVAVDAEEGRRRREDNMVEIRKSKREESLQKKRREGLQAQQLSASLQSSNVEKKLESLPSMVAGVWSSNGSAQLEATTQFRKLLSIERSPPIDEVIQSGVVPRFVEFLMREDYPQLQFEAAWALTNIASGTSEHTKVVIDHGAVPIFVKLLGSPSDDVREQAVWALGNVAGDSPRCRDLVLSHGALMPLLAQLNEHSKLSMLRNATWTLSNFCRGKPQPPFDQVRPALPALERLIHSNDEEVLTDACWALSYLSDGTNDKIQAVIEAGVCPRLVELLLNPSPSVLIPALRTVGNIVTGDDLQTQCIIDHGALSCLLSLLTHNHKKSIKKEACWTISNITAGNKEQIQAVINAGIIGPLVSLLQNAEFDIKKEAAWAISNATSGGTHEQIKYLVSEGCIKPLCDLLACPDPRIITVCLEGLENILKVGEAEKAAGAGEFNYCAQLIEDAEGLEKIENLQSHDNNEIYEKAVKILETYWLEEDEETLPPGDGTQQNFHFGGNDVKVPTGGFNFS

SEQ ID NO: 6553 - protein, 528 aa, Gossypium hirsutum
MSLRPSTRTEVRRNRYKVAVDAEEGRRRREDNMVEIRKSKREESLQKKRREGLQAQQLSASLQSSNVEKKLESLPSMVAGVWSSNGSAQLEATTQFRKLLSIERSPPIDEVIQSGVVPRFVEFLMREDYPQLQFEAAWALTNIASGTSEHTKVVIDHGAVPIFVKLLGSPSDDVREQAVWALGNVAGDSPRCRDLVLSHGALMPLLAQLNEHSKLSMLRNATWTLSNFCRGKPQPPFDQVRPALPALERLIHSNDEEVLTDACWALSYLSDGTNDKIQAVIEAGVCPRLVELLLNPSPSVLIPALRTVGNIVTGDDLQTQCIIDHGALSCLLSLLTHNHKKSIKKEACWTISNITAGNKEQIQAVINAGIIGPLVSLLQNAEFDIKKEAAWAISNATSGGTHEQIKYLVSEGCIKPLCDLLACPDPRIITVCLEGLENILKVGEAEKAAGAGEFNYCAQLIEDAEGLEKIENLQSHDNNEIYEKAVKILETYWLEEDEETLPPGDGTQQSFHFGGNDVKVPTGGFNFS

SEQ ID NO: 6554 - protein, 528 aa, Unknown
  Sequence found in Organisms: Gossypium hirsutum, Gossypium raimondii
MSLRPSTRTEVRRNRYKVAVDAEEGRRRREDNMVEIRKSKREESLQKKRREGLQAQQLSASLQSSNVEKKLESLPSMVAGVWSSNGSAQLEATTQFRKLLSIERSPPIDEVIQSGVVPRFVEFLMREDYPQLQFEAAWALTNIASGTSEHTKVVIDHGAVPIFVKLLGSPSDDVREQAVWALGNVAGDSPRCRDLVLSHGALMPLLAQLNEHSKLSMLRNATWTLSNFCRGKPQPPFDQVRPALPALERLIHSNDEEVLTDACWALSYLSDGTNDKIQAVIEAGVCPRLVELLLNPSPSVLIPALRTVGNIVTGDDLQTQCIIDHGALSCLLSLLTHNHKKSIKKEACWTISNITAGNKEQIQAVINAGIIGPLVSLLQNAEFDIKKEAAWAISNATSGGTHEQIKYLVSQGCIKPLCDLLACPDPRIITVCLEGLENILKVGEAEKAAGAGEFNYCAQLIEDAEGLEKIENLQSHDNNEIYEKAVKILETYWLEEDEETLPPGDGTQQSFHFGGNDVKVPSGGFNFS

SEQ ID NO: 6555 - protein, 274 aa, Ambrosia trifida
MSLRPNARTEVRRNRYKVAVDADEGRRRREDNMVEIRKSKREENLQKKRREGLAATQFPVPVQSVSASEKKLKTYLQCSGVLSDDSNMQLEATTQFRKLLSIERSPPIEEVIQSGVVLRFVEFLMREDYPQLQFEAAWALTNIASGTSEHTKVVIDHGAVPIFVKLLSSSSDDVREQAVWALGNVAGDSPKCRDLVLAQGALPSLLAQLNAQSKLSMLRNATWTLSNFCRGKPQPSFDQTRPALPALQQLIHSNDEEVLTDALLGTFISFRWYE

SEQ ID NO: 6556 - protein, 439 aa, Ambrosia trifida
MQLEATTQFRKLLSIERSPPIEEVIQSGVVPRFVEFLMREDYPQLQFEAAWALTNIASGTSEHTKVVIDHGAVPIFVKLLASNSDDVREQAVWALGNVAGDSPKCRDLVLAQGALPSLLAQLNAQSKLSMLRNATWTLSNFCRGKPQPSFDQTRPALPALQQLIHSNDEEVLTDACWALSYLSDGTNDKIQAVIEANVCPRLIELLNHPSPSVLIPALRTVGNIVTGDDMQTQYIINHQALPCLLNLLTNNHKKSIKKEACWTISNITAGNKEQIQTVIEANIIGPLVLLLQNAEFDIKKEAAWAISNATSGGSHDQIKYLVSQGCIKPLCDLLVCPDPRIVTVCLEGLENILKVGEAEKNLGRSGDVNLYAQMIDDAEGLEKIENLQSHDNNEIYEKAVKLLETYWMEEEEDDGMPTGQSGFPLGGDVSVPNGGFNFS

SEQ ID NO: 6557 - protein, 377 aa, Helianthus annuus
MSLRPSARTEVRRNRYKVAVDADEGRRRREDNMVEIRKSKREESLQKKRREGIAASQFPLPVQSASASEKKLENLPAMVAGVLSDDNNMQLEATTQFRKLLSIERSPPIEEVIQSGVVPRFVEFLMREDFPQLQFEAAWALTNIASGTSEHTKVVIDHGAVPIFVKLLASPSDDVREQAVWALGNVAGDSPKCRDLVLAQGALSSLLAQLNEHSKLSMLRNATWTLSNFCRGKPQPSFDQTRPALPALQQLIHSNDEEVLTDACWALSYLSDGTNDKIQAVIEANVCPRLIELLNHPSPSVLIPALRTVGNIVTGDDMQTQYIINHQALPCLLNLLINNHKKSIKKEACWTISNITAGNKKQIQTVIEANLVAPLDQ

SEQ ID NO: 6558 - protein, 530 aa, Triphysaria pusilla
MSLRPNAKTEVRRSRYKVAVDADEGRRRREDNMVEIRKNKREENLLKKRREGLQAQQFQPAVNAPLLEKKLETLPSMVAGIWSNDSALQLEATTQFRKLLSIERNPPIEEVIQSGVVPRFVEFLARDDYPQLQFEAAWALTNIASGTSDNTRVVIDHGAVPIFVRLLSSPSDDVREQAVWALGNVAGDSPKCRDLVLGYGALMPLLAQFNEHVKLSMLRNATWTLSNFCRGKPQPQFDQVKPALPALALLIRSNDEEVLTDACWALSYLSDGVNDKIQAVIESGVCPRLIELLQHTSPSVLIPALRTVGNIVTGDDLQTQAIIDYRSLPSLLNLLTQNHKKSIKKEACWTISNITAGNKDQIQAVIEAGIISPLVLLLQNAEFEIKKEAAWAISNATSGGTNDQIKFLVREGCIKPLCDLLVCPDPRIVTVCLEGLENILKVGEAEKNQGTTGEVNVFAQMIDDAEGLEKIENLQSHDNNEIYEKAVKILEMYWLEEDDEQQLVSDDAPQSGFNFGGGDLPVPSGGFKFG

SEQ ID NO: 6559 - protein, 319 aa, Sorghum bicolor
MALRALDNTMPAAVEERPKKVAKVGVPAAAAAVKATSPGSGDKKKKKGNDENSAPRATTAAAEQAVEYIPSEELAAAASPKAKAAGLVADLDSKDWVKTCEALNDARRLAIHHPALLNPILEKVVLAVVKTMKSPRSAVLKTSIMACADIFSSFGNLLSSVSDDAFDKLLLQLLLKASQDKRFVCEEAEKAMRAMAASMPPLPLLKKLKAYVHHANLRVRAKAAVAISHCAARMDIEAMKEFGMSALLQVAAELLNDRLPEAREAARGVVSSMHAAFAKDAAASGQEDDAAASWESLCSLSLPPISAVAVAKITASSSS

SEQ ID NO: 6560 - protein, 321 aa, Setaria italica
MALRALDNTMPAVVEERPKKVAKVAVPAPAAAVKAASPGSGKKKKKNDENSAPRATAAAGEQAVEYIPSAELEAAAHPKAKAAGLVAELDSKDWIRACEALNDARRLAIHHSALLNPILEKVMLAIVKTMKNPRSAVLKTSIMACTDIFNSCGNLLSSVSDDAFDKLLLQLLLKASQDKRFVCEEAEKAMRAMAASMPPLPLLKKLKAYVHHANLRVRAKAAVAISHCAARMDIEAMKEFGMSALLQVAAELLNDRLPEAREAARSVVGSMHGAFAKEAAARGEEEEADAPTVAASWESLCSLSLPPISAQAVVKIASSSQ

SEQ ID NO: 6561 - protein, 321 aa, Panicum virgatum
  misc_feature (38)..(39): Xaa can be any naturally occurring amino acid
MALRALDNTMPAAVEERPKKVAKVAAPTEAAPVKAASXXSGKRKKKNDENSAPRATAAAGEQAVEYIPSEELEAAAHPKAKAAGLVAELDSKDWIRACEALNDARRLAIHHSALLNPIVEKVMLAIVKTMKSPRSAVLKTSIMACTDIFNSFGNILSSVSDDAFDKLLLQLLLKASQDKRFVCEEAEKAMRAMAASMPPLLLLKKLKAYVHHANLRVRAKAAVAISHCAARMDIAAMKEFGMSALLQVAAELLNDRLPEAREAARSVVGSMHGAFAKEAAAKGKEEEDAPSVAASWESLCSLSLPPISAQAVAKIAATQSQ

SEQ ID NO: 6562 - protein, 560 aa, Sorghum bicolor
MKMHRFALPGLGFLVLWMLLHCGSELAAAVPPDGWYDYSAYTDCRGQPEPALYNGGILKFGNSDDSDGYRTTETGVFSPAFVVYNLNKTTMYTFSCWVKLEGAYSALITARLAPDNTGARCIATVLARSDCWAFVKGGFVLDWPTQTSVIFFQNADKTPMKITVASGSLQPFTTDQWAMHQQDTIRKRRKRVATIHVADPQGARVVGASVSVQQTAKDFPIGSAIASTILGNQAYQQWFVDRFNAAVFEDELKWYSTEPMSGLLRFDVPDQMLAFVRSHRVMVRGHNIFWENQDATPRWVKNLTADDLRSAVNTRIQSLMTRYRGEFAHWDVNNEMLHYNFYEQRLGPNASMDFFSVAQDADPLATLFMNEYNVIETCDDPFSTVDTYVAKLKELRSGGAILEGIGLEGHFSKPNIPLMRAILDKLATLGLPIWFTEIDISNKFDAQTQAAYLEQVLREAYSHPAVSGVMLWTALHPSGCYQMCLTDWNLANLPTGDVVDRLLNEWRTLQAGGQTDAHGAYSFSGYLGEYVLTVSYNNRTTQSTFSLSPGDETRHINVQM

SEQ ID NO: 6563 - protein, 543 aa, Saccharum officinarum
MKMHRFALRGLGSLVLWMLLHCGSELAAAVPPDGWYDYSAYTDCRGQPEPALYNGGILKYGNSGDDPDGYRTTETGVFSPAFVVYNLNKTTMYTFSCWVKLEGAYSALITARLAPDNTGARCIATVLARSDCWAFVKGGFVLDWPTQTSVIFFQNADKTPMKITVASGSLQPFTTDQWAMHQQDTIRKRRKRVATIHVADPQGARVVGASVSVQQTAKDFPIGSAIASTILGNQAYQQWFVDRFNAAVFEDELKWYSTEPMSGLLRFDVPDQMLAFVRSHRVMVRGHNIFWENQDATPRWVKNLTADDLRAAVNTRIQSLMTRYRGEFAHWDVNNEMLHYNFYEQRLGPNASMEFFSVAQDADPLATLFMNEYNVIETCDDPFSTVDTYVDKLKELRSGGAILEGIGLEGHFSKPNIPLMRAILDKLATLGLPIWFTEIDISNKFDAQTQATYLEQVLREAYSHPAVSGVMLWTALHPNGCYQMCLTDWNLSNLPTGDVVDRLLNEWRTLQAGGQTDAHGAYRFSGYLGEYVLTVSYNNRTTQ

SEQ ID NO: 6564 - protein, 560 aa, Setaria italica
MRTPRQALHAAGFLALWMLLHCGIELVAAVPPPGWYDYTSYTDCRGQPEPALYNGGILKFGNSDDPDGYRTTETGVFSPAFVVYNLNKTTMYTFSCWVKLEGASAALITARLAPDNSGARCIATVLARSDCWAFVKGGFVLDWPTQTSVIFFQNADKTPMKITVASGSLQPFTTDQWAMHQQDTIRKRRKRVATIHVADPQGARVVGASVSVQQTTKDFPIGSAIASTILGNQAYQQWFVDRFNAAVFEDELKWYSTEPMSGLLRFDVPDQMLAFVRSHRVMVRGHNIFWENQDATPRWVKNLTADDLRSAVNTRIQSLMTRYRGEFAHWDVNNEMLHYNFYEQRLGPNASMEFFSVAQDADPLATLFMNEYNVIETCDDPFSTVDTYVAKLKELRAGGAILEGIGLEGHFSKPNIPLMRAILDKLATLGLPIWFTEIDISNKFDAQTQAAYLEQVMREAYSHPAVSGVMLWTALHQSGCYQMCLTDWNLNNLPTGDVVDRLLNEWRTLQAGGQTDAHGAYSFSGYLGEYTLTVSYNNRTTQSTFSLSPGDETRHINVQM

SEQ ID NO: 6565 - protein, 415 aa, Setaria italica
MRTPRQALHAAGFLALWMLLHCGIELVAAVPPPGWYDYTSYTDCRGQPEPALYNGGILKFGNSDDPDGYRTTETGVFSPAFVVYNLNKTTMYTFSCWVKLEGASAALITARLAPDNSGARCIATVLARSDCWAFVKGGFVLDWPTQTSVIFFQNADKTPMKITVASGSLQPFTTDQWAMHQQDTIRKRRKRVATIHVADPQGARVVGASVSVQQTTKDFPIGSAIASTILGNQAYQQWFVDRFNAAVFEDELKWYSTEPMSGLLRFDVPDQMLAFVRSHRVMVRGHNIFWENQDATPRWVKNLTADDLRSAVNTRIQSLMTRYRGEFAHWDVNNEMLHYNFYEQRLGPNASMEFFSVAQDADPLATLFMNEYNVIETCDDPFSTVDTYVAKLKELRAGGAILEGIGLTSPSPTSR

SEQ ID NO: 6566 - protein, 562 aa, Panicum virgatum
MRTPRSAPRAVAGFVVLWMLLHCGSELVAAVPPDGWYDYAAYTDCRGQPEPALYNGGILKFGNSDDPDGYRTTETGVFSPAFVVYNLNKTTMYTFSCWVKLEGASNALITARLAPDNTGARCIATVLARSDCWAFVKGGFVLDWPTQTAVIFFQNADKTPMKITVASGSLQPFTTDQWAMHQQDTIRKRRKRVATIHVADPQGARVVGASVSVQQTAKDFPIGSAIASTILGNQAYQKWFVDRFNAAVFEDELKWYSTEPTSGLLRFDVPDQMLAFVRSHRVMVRGHNIFWENQDATPRWVKNLTSPDDLRAAVNARIQGLMTRYRGEFAHWDVNNEMLHYNFYEQRLGPNASMEFFSVAQDADPLATLFMNEYNVIETCDDPFSTVDTYAAKLRELRAGGAILEGIGLEGHFSRPNIPLMRAILDKLATLGLPIWFTEIDISSKFDAQTQAAYLEQVLREAYAHPAVSGVMLWTALHPSGCYQMCLTDWGLNNLPTGDVVDRLLNEWRTLQAGGQTDAHGAYSFSGFLGEYILTVTYNNRTTQSTFSLSPGDETRHINVQM

SEQ ID NO: 6567 - protein, 558 aa, Oryza sativa
MRRFSLHAVRYLVLWMLLRCGRELVAAVPPDGWYDYTAYTDCRGQPEPALYNGGILRFGNSDDPTGYRTTETGVFSPAFVVYNLNKTTMYTFSSWVKLEGASSALITARLALDNAGARCIGTVLARNDCWAFLKGGFVLDWPTQTSVIFFQNADKTPMKITVASGSLQPFTSDQWSMHQKDTIRKRRKRMATIHVADQQGGRVVGASVSVRQTAKDFPFGSAIASTILGNQAYQKWFVDRFNAAVFEDELKWYSTEPMSGQLRFDVPDQMLAFVRSHRVMVRGHNIFWENQDATPSWVKGLSPDDLRAAVNGRIQNLMTRYRGEFAHWDVNNEMLHYNFYEQRLGANASVEFFSVAQDADPLATLFMNEFNVIETCDDVSSTVDTYVAKLKDLRAGGAVLEGIGLEGHFLKPNIPLMRAVLDKLATLGLPIWFTEIDISNRYDAQTQAVYLEQVLREAYSHPAVTGVMLWTALHPNGCYQMCLTDWNLNNLPVGDVVDRLLQEWQTGQAAGPTDAHGAYSFSGFLGEYIVSVTYANSTSQATFSLSPGDETRHINIQI

SEQ ID NO: 6568 - protein, 563 aa, Brachypodium distachyon
MRRSHSFVSALKHVVLFLVSWMVHCGNELVAAVPPDGWYDYSAYTDCRGQPEPALYNGGILKYGNSDDPTGYHTTETGVLSPAFVVYNLNKTTMYTFSSWVRLEGSDSALITARLAPDNSGTRCIGTVLARNDCWSFLKGGFVLDWPTQTSVIFFQNADKTPMKITVARGSLQPFTTDQWAMHQKDTIRKRRKRMATIHVADPQGSRVVGASVSVQQTAKDFPFGSAIASTILGNEAYQKWFVDRFNAAVFEDELKWYSTEPASGLLRFDVPDQMLAFVRSHRVMVRGHNIFWENQEATPRWVKGLSPEDLRSAVNTRIQSLMTRYRGEFAHWDVNNEMLHYNFYEQRLGPNATVEFFSVAQDADPLATLFMNEYNVIETCDDVSSTVDAYVARLKDLRAGGAVLEGIGLEGHFSKPNIPYMRAVLDKLATLGLPIWFTEIDINNKFDAQTQAVYLEQVLREAYSHPAVSGVMLWTALHQNGCYQMCLTDWDLKNLPVGDVVDRLLQEWQTGQAAGNTDAHGAYSFSGYLGEYVVTVSSGNSSAQSTFSLSPGDETRHITLHI

SEQ ID NO: 6569 - protein, 561 aa, Secale cereale
MRSRSSFALNHAVVFLVSLMVHCGSELVAAVPPDGWYDYTAHTDCRGRPEPAQYNGGILKYGNGDDPNGYKTTETGVLSPAFVVYNLNKSTMYTFSGWVKLEGSSSALITARLAPDNSGTRCIGTVLARSDCWAFLKGGFVLDWPTQTSVIFFQNADRTPMKITIASSSLQPFTTDQWSMHQKDMIRKRRKRMATIHVADPHGTRVVGASVSVEQTAKDFPFGSAIASTILGNDAYQKWFVDRFNAAVFEDELKWYSTEPASGLLRFDVPDQMLAFVRSHRVMVRGHNIFWENQDATPRWVKGLSPDDLRSAVNTRIQSLMTRYRGEFAHWDVNNEMLHFNFYEQRLGPNATMEFFSVAQDADPLATLFMNEYNVVETCDDVSSTVDAYVARLKDLRAGGAVLEGIGLEGHFSKPNIPYMRAVLDKLATLNLPIWFTEIDINNKFDAQTQAVYLEQVLREAYAHPAVSGVMLWTALHENGCYQMCLTDWNLKNLPVGDVVDRLLQEWQTGQAAGPTDAHGAYSFSGYLGEYVVTVSAGNTSKQSTFSLSPGDETRHITVQI

SEQ ID NO: 6570 - protein, 384 aa, Hordeum vulgare
MVDAPERYDPEEEEEDGHHTRRRPARHPRGGRVGVRAADRQGLPVGVGDRLHHPGKRRVPEMVRGAFNAAVFEDELKWYSTEPASGLLRFDVPDQMLAFVRSHRVMVRGHNIFWENQDATPRWVKGLSPEDLRSAVNTRIQSLMTRYRGEFAHWDVNNEMLHFNFYEQRLGPNATMDFFSVAQDADPLATLFMNEYNVVETCDDASSTVDAYVARLKDLRAGGAVLEGIGLEGHFSKPNIPYMRAVLDKLATLNLPIWFTEIDINNKFDAQTQAVYLEQVLREAYAHPAVSGVMLWTALHENGCYQMCLTDWNLKNLPVGDVVDRLLQEWQTGQAAGPTDAHGAYSFSGYLGEYVVTVNAGNTSKQATFSLSPGDETRHITIQI

SEQ ID NO: 6571 - protein, 561 aa, Triticum aestivum
MRSRGSFALGHAVVFLAWLMVHCGGGLVGAVPPDGWYDYTAHTDCRGRPEPAQYNGGILKYGNGDDPNGYKTTETGVLSPAFVVYNLNKSTMYTFSGWVKLEGSPSALITARLAPDNSGTRCIGTVLARSNCWAFLKGGFVLDWPTQTSVIFFQNADRTPMKITTASASLQPFTTDQWSMHQKDTIRKRRKRMATIHVADPHGTRVVGASVSVEQTSKDFPLGSAIASTILGNDAYQKWFVERFNAAVFEDELKWYSTEPASGLLRFDVPDQMLAFVRSHRVMVRGHNIFWENQDATPRWVKGLSPEDLRSAVNTRIQSLMTRYRGEFAHWDVNNEMLHFNFYEQRLGANATMEFFSVAQDADPLATLFMNEYNVVETCDDASSTVDAYVARLKDLRAGGAVLEGIGLEGHFSRPNIPYMRAVLDKLATLNLPIWFTEIDINNKFDAQTQAVYLEQVLREAYAHPAVSGVMLWTALHEGGCYQMCLTDWNLKNLPVGDVVDRLLQEWQTGQVAGPTDAHGAYSFSGYLGEYVVTVNAGNSSKQSTFSLSPGDETRHITVQI

SEQ ID NO: 6572 - protein, 558 aa, Sorghum bicolor
MNGVEEQQPPQVSSMSKTLDGVTKPSLGKEPIPGSELWTDGLICAFELVKSHRKPVQHKSWPAMEQMQEKGPTMYTRKHSRRNGHQITVPKADESIVLENPHQTDFSNDPSVLKDRPLYAGEILDHKWVPIGWSRIAELVLRVQSDSSWENELTEISDSEDDYTVADLAAPYWQRPVGPTWWCHVAAGHPSIDAWLNSAHWMHPAIRTALRDESKLISDRMKYLLYEVPVRVAGGLLFELLGQSIGDPNHEEEDIPIVLRSWQAQNFLVTTLHVKGPSSNLNVLGVTEVQELLLAGGSQTPRSVHEVIAHLVSRLSRWDDRLFRKYVFGEADEIELKFVNRRNREDLNLISIILNQEIRRLATQVIRVKWSLHAREEILLELLRHLRGNATRAILESIRKCTRDMLEEQEAVRGRLFTIQDVMQSTVRAWLQDRSLRVTHNLAIFGGCGMVLSIITGLFGINVDGIPGAQNTPYAFGLFAGLLFFIGIVLIGVGMLYLGLQNPVNSEKMKVRKLELQQLVSMFQHEAEQHGKVREGLSRHGSSPSSSAASDEGYILIS

SEQ ID NO: 6573 - protein, 558 aa, Setaria italica
MNGAEEEQPPQVSNMSKMQDTAPKPSLGKEPIPGSELWTDGLICAFELVKGHRKTVHHKSWPTIDQMQEKGSTMYTRKHSRRNGHHIIAPKPDESIVLENPHQTEISNDPKVLKDRPLYAGEILDHKWVPIGWTRIAELVQRVQSDSSWENELTEISDSEDDYTVADLAAPYWQRPVGPTWWCHVTAGHPFIDAWLNSAHWMHPAIRTALRDESKLISDRMKYLLYEVPVRVAGGLLFELLGQSVGDPNHEEEDIPIVLRSWQAQNFLVTAMHVKGPSSNINVLGVTEVQELLLAGGSQTPRSVHEVIAHLVSRLSRWDDRLFRKYIFGEADEIELKFVNRRNREDLNLLSIILDQEIRRLATQVIRVKWSLHAREEILHELVRHLRGNNTRVILDSVRKCTRNMLEEQEAVRGRLFTIQDVMQSTVRAWLQDRSLRVTHNLAIFGGGGMVLSIITGLFGINVDGIPGAQNTPYAFGLFTGLLFFLGIVLVVVGMLYLGLQNPVSSEKVKVRKLELQQLVSMFQHEAEQHGKVREGLSRHGLSPRSSADSDEGYILIS

SEQ ID NO: 6574 - protein, 558 aa, Oryza sativa
MADVEGQQPHQVSGVSRAQDGVAKVSLGKEHVPGSELWTDGLICAFELIKGHKKLVQHKSWPTIDSMQEKEVPMHMKRHISRNGHHVATMKPEECDVVENPRQTEFANDPSLFKDRPVHVRAILDHKWVPIGWSRIAELVQRVQSDASWDSEPAEMTDSEDDYTVADVAAPYWQRPVGPTWWCHVTAGHPSVDAWLNSAHWMHPAIRTALRDESRLISDRMKYLLYEVPVRVAGGLLFELLGQSVGDPNREEEDIPIVLRSWQAQNFLVTAMHVKGPSSNINVLGVTEVQELLSAGGSQTPRSAHEVIAHLIGRLSRWDDRLFRKYVFGEADEIELKFVNRRNHEDLNLVSIILNQEIRRLATQVIRVKWSLHAREEIIIELLRHLRGNTTRVILDSIRKDTREMLEEQEAVRGRLFTIQDVMQSTVRAWLQDRSLRITHNLAIFGGGGMVLSIITGLFGINVDGIPGAQNTPYAFGLFAGLLFFVGFVLIGVGILYLGLQNPVTNEKVKVRKLELQDLVSAFQHEAEQHGKVREGLSRHSSSPKSSSASNVDYVLIS

SEQ ID NO: 6575 - protein, 560 aa, Brachypodium distachyon
MTDVEGQPPPQISSSMSKVQDGSGGNPNLAKECHILGSELWTNGLICAFELVKGHRKIVHHKSWPAIELAQEKVVHMKKHRGRDGHHVVNPTPDESNVVEIPGQTELGNDPSVLKDRPPYPAEILDHKWVPIGWSRIGELIQRVQSDASWENEQVMISDSEDDYTVADVAAPYWQRPGGPTWWFHVTAGHPYVDAWLSSAHWMHPAIRTALRDESRLISDRMKYLLYEVPVRVAGGLLFELLGQSVGDPNHEEEDIPIVLRSWQAQNFLLTAMHVKGHSPNINVLGVTEVQELLISDGSQTPRSVHEVIAHLVSRLSRWDDRLFRKYIFGKADEIELKFVNRRNSEDLNLVSIILNQEIRRLAKQVIRVKWSLHAREEIILELLRHLRGNATRAILERERKSAREMLEEQEAVRGRLFTIQDVMQSTVRAWLQDRSLRITHNLAVFGGGGIVLSIITGLFGINVDGIPGAQNTPYAFGLFAGLLFFIGAVLVGVGLMYLGLTKPVTSEKVNVRKLELQQLVSVFQREAEQHGKVREGLSRHGLSSGSSSASPGEGYILIS

SEQ ID NO: 6576 - protein, 187 aa, Zea mays
MAAQREKSAAVAVGPAHGAAVSGSPSPSSSSGGPAAASSSGERWSAAIGNLGELGANVDALQKMLGRKAVFVDDDIFSKASLAADQARTIKVLDQRVQSLERELDAAISAAARARTDKRQAEAAQRAAELRTQEVTKELENTARVFQLHMEELRLKQEEIAKKDSDIKVLEAIIRTLGSKDDDGSSE

SEQ ID NO: 6577 - protein, 191 aa, Sorghum bicolor
MAAQREKSAVAAAAHGAAVSGSPSPSSSSGGPAAASSGERWSAAIGNLGELGANVDALQKLLGRKAVFVDDDIFSKASLAADQARTIKVLDQRVQSLERELDAAISAAARARTEKRQAEAAQRAAELRTQEVTKELENTARVFELHMEELRLKQEEIAKKDSDIKVLEAIIRTLSSKDDTLSSKDDDGSSE

SEQ ID NO: 6578 - protein, 188 aa, Saccharum officinarum
MAAHREKSAAVAVAPVSGSPSPSSSSGGPAAAAAGERWSAAIGNLGELGANVDALQKLLGRKAVFVDDDIFSKASLAADQARTIKVLDQRVQSLERELDAAISAAARARTEKRQAEAAQRAAELCTQEVTKELENTARVFELHMEELRLKQEEIAKKDSDIKVLEAIIRTLSSKDDTLSSKDDDGSSE

SEQ ID NO: 6579 - protein, 193 aa, Setaria italica
MAAQREKAAAAVAPAPGAAAASGSPSPSSSSGAPAAAASGERWSAAIGNLGELGANVDGLQKLLARKAVFVDDDIFSKASLAADQARTIKVLDQRVQSLERELDAAISAAARARTEKRQAEAGQRAAELRAQEVTKELENTARVFELHMEELRLKQEEIAKKDSDIKVLEAIIRTLSSKDDTLSSKDDDGSSE

SEQ ID NO: 6580 - protein, 249 aa, Zea mays
MSSIGTGYDLSVTTFSPDGRVFQVEYATKAVDNSGTIVGIKCKDGIVLGVEKLVTSKMMLEGSNRRIHSVHRHSGLAVAGLAADGRQIVSRTKSEAASYEKVYGEPISVKELADRVASYVHLCTLYWWLRPFGCGVILGGYDRDGPQLYMIEPSGVSYKYFGAALGKGRQAAKTEIEKLKLSELTCREGIVEVAKIIYGVHDEAKDKAFELELSWICDESNRQHQKVPNELLEQAKAAAQAALEEMDAD

SEQ ID NO: 6581 - protein, 249 aa, Cynodon dactylon
MSSIGTGYDLSVTTFSPDGRVFQVEYATKAVDNSGTVVGIKCKDGIVLGVEKLVTSKMMLEGSNRRIHSVHRHSGLAVAGLAADGRQIVSRAKSEAASYEKVYGEPISVKELADRVASYVHLCTLYWWLRPFGCGVILGGYDRDGPQLYMIEPSGVSYKYFGAALGKGRQAAKTEIEKLKLSELTCREGIVEVAKIIYGVHDEAKDKAFELELSWICDESNRQHQKVPNDLLEQAKAAAQAALEEMDAD

SEQ ID NO: 6582 - protein, 249 aa, Saccharum officinarum
MSSIGTGYDLSVTTFSPDGRVFQVEYATKAVDNSGTVVGIKCKDGIVLGVEKLVTSKMMLEGSNRRIHSVHRHSGLAVSGLAADGRQIVSRTKSEAASYEKVYGEAISVKELADRVASYVHLCTLYWWLRPFGCGVILGGYDRDGPQLYMIEPSGVSYKYFGAALGKGRQAAKTEIEKLKLSELTCREGIVEVAKIIYGVHDEAKDKAFELELSWICDESNRQHQKVPNELLEQAKAAAQAALEEMDAD

SEQ ID NO: 6583 - protein, 249 aa, Saccharum officinarum
MSSIGTGYDLSVTTFSPDGRVFQVEYATKAVDNSGTVVGIKCKDGIVLGVEKLVTSKMILEGSNRRIHSVHRHSGLAVAGLAADGRQIVSRTKSEAASYEKVYGEPIPVKELADRVASYVHLCTLYWWLRPFGCGVILGGYDRDGPQLYMIEPSGVSYKYFGAALGKGRQAAKTEIEKLKLSELTCREGIVEVAKIIYGVHDEAKDKAFELELSWICDESKRQHEKVPNELLEQAKAAAQAALEEMDAD

SEQ ID NO: 6584 - protein, 249 aa, Sorghum bicolor
MSSIGTGYDLSVTTFSPDGRVFQVEYATKAVDNSGTVVGIKCKDGIVLGVEKLVASKMMLEGSNRRIHSVHRHSGLAVAGLAADGRQIVSRTKLEAASYEKVYGEAISVKELADRVASYVHLCTLYWWLRPFGCGVILGGYDRDGPQLYMIEPSGVSYKYFGAALGKGRQAAKTEIEKLKLSELTCREGIVEVAKIIYGVHDEAKDKAFELELSWICDESNRQHQKVPNELLEQAKAAAQAALEEMDAD

SEQ ID NO: 6585 - protein, 249 aa, Cenchrus ciliaris
MSSIGTGYDLSVTTFSPDGRVFQVEYATKAVDNSGTVVGIKCKDGIVLGVEKLVTSKMMLEGSNRRIHSVHRHTGLSVAGLAADGRQIVSRAKSEAASYEKVYGEPIPVKELADRVASYVHLCTLYWWLRPFGCGVILGGYDRDGPQLYMIEPSGVSYKYFGAALGKGRQAAKTEIEKLKLSELTCREGIVEVAKIIYGVHDEAKDKAFELELSWVCDESNRQHQKVPNDLLEQAKAAAQAALEEMDAD

SEQ ID NO: 6586 - protein, 249 aa, Zea mays
MSSIGTGYDLSVTTFSPDGRVFQVEYATKAVDNSGTVVGIKCKDGIVLGVEKLVTSKMMLEGSNRRIHSVHRHSGLAVAGLAADGRQIVSRTKSEAASYEKVYGEPISVKELADRVASYVHLCTLYWWLRPFGCGVILGGYDRDGPQLYMIEPSGVSYKYFGAALGKGRQAAKTEIEKLKLSELTCREGIVEVAKIIYAVHDEAKDKAFELELSWICEESKRQHQKVPNDLLEHAKAAAQTALEEMDAD

SEQ ID NO: 6587 - protein, 249 aa, Pennisetum glaucum
MSSIGTGYDLSVTTFSPDGRVFQVEYATKAVDNSGTVVGIKCKDGIVLGVEKLVTSKMMLEGSNRRIHSVTRHSGLSVAGLAADGRQIVSRAKSEAASYEKVYGEPIPVKELADRVASYVHLCTLYWWLRPFGCGVILGGYDRDGPQLYMIEPSGVSYKYFGAALGKGRQAAKTEIEKLKLSELTCREGIVEVAKIIYGVHDEAKDKAFELELSWVCDESNRQHQKVPNDLLEQAKAAAQAALEEMDAD

SEQ ID NO: 6588 - protein, 249 aa, Panicum virgatum
MSSIGTGYDLSVTTFSPDGRVFQVEYATKAVDNSGTVVGIKCKDGIVLGVEKLVTSKMMLEGSNRRIHSVHRHSGLAVAGLAADGRQIVSRAKSEAASYEKVYGEAISVKELADRVASYVHLCTLYWWLRPFGCGVILGGYDRDGPQLYMIEPSGVSYKYFGAALGKGRQAAKTEIEKLKLSELTCREGIVEVAKIIYGVHDEAKDKAFELELSWVCDESNRQHQKVPNDLLEQAKAAAQAALEEMDAD

SEQ ID NO: 6589 - protein, 249 aa, Setaria italica
MSSIGTGYDLSVTTFSPDGRVFQVEYATKAVDNSGTVVGIKCKDGIVLGVEKLVTSKMMLEGSNQRIHSVHRHSGLSVAGLAADGRQIVSRAKSEAASYEKVYGEPISVKELADRVASYVHLCTLYWWLRPFGCGVILGGYDRDGPQLYMIEPSGVSYKYFGAALGKGRQAAKTEIEKLKLSELTCREGIVEVAKIIYGVHDEAKDKAFELELSWVCDESNRQHQKVPNDLLEQAKAAAQAALEEMDAD

SEQ ID NO: 6590 - protein, 249 aa, Oryza sativa
MSSIGTGYDLSVTTFSPDGRVFQVEYATKAVDNSGTVVGIKCKDGIVLGVEKLVTSKMMLEGSNRRIHSVHWHSGLAVAGLAADGRQIVSRAKSEAASYEKVYGEPISVKELADRVASYVHLCTLYWWLRPFGCGVILGGYDRDGPQLYMIEPSGVSYKYFGAALGKGRQAAKTEIEKLKLSELTCREGIVEVAKIIYGVHDEAKDKAFELELSWICDESNRQHQKVPADLLEQAKVAAQAALEEMDAD

SEQ ID NO: 6591 - protein, 249 aa, Sorghum bicolor
MSSIGTGYDLSVTTFSPDGRVFQVEYATKAVDNSGTIVGIKCKDGIVLGVEKLVTSKMILEGSNRRIHSVHHHSGLAVAGLAADGRQIVSRTKSEAASYEKVYGEPIPVKELADRVASYVHLCTLYWWLRPFGCGVILGGYDRDGPQLYMIEPSGVSYKYFGAALGKGRQAAKTEIEKLKLSELTCREGIVEVAKIIYGVHDEAKDKAFELELSWICDESKRQHEKVPNDLLEQAKAAAQAALEEMDAD

SEQ ID NO: 6592 - protein, 249 aa, Panicum virgatum
MSSIGTGYDLSVTTFSPDGRVFQVEYATKAVDNSGTVVGIKCKDGIVLGVEKLVTSKMMLEGSNRRIHSVHRHSGLAVAGLAADGRQIVSRAKSEAASYEKVYGEAISVKELADRVASYVHLCTLYWWLRPFGCGVILGGYDTDGPQLYMIEPSGVSYKYFGAALGKGRQAAKTEIEKLKLSELTCREGIVEVAKIIYGVHDEAKDKAFELELSWVCDESNRQHQKVPNDLLEQAKAAAQAALEEMDAD

SEQ ID NO: 6593 - protein, 249 aa, Saccharum officinarum
MSSIGTGYDLSVTTFSPDGRVFQVEYATKAVDNSGTVVGIKCKDGIVLGVEKLVTSKMILEGSNRRIHSVYHHSGLAVAGLAADGRQIVSRAKSEAASYEKVYGEPISVKDLADRVASYVHLCTLYWWLRPFGCGVILGGYDRDGPQLYMIEPSGVSYKYFGAALGKGRQAAKTEIEKLKLSELTCREGIVEVAKIIYGVHDEAKDKAFELELSWICDESKRQHQKVPNELLEQAKAAAQAALEEMDAD

SEQ ID NO: 6594 - protein, 249 aa, Brachypodium distachyon
MSSIGTGYDLSVTTFSPDGRVFQVEYAGKAVDNSGTIVGIKCKDGIVLGVEKLITSKMILEGSNRRLHSVHRNSGLAVAGLAADGRQIVSRAKSEAANYEKVYGEPMPVKELADRVASYVHLCTLYWWLRPFGCGVILGGYDRDGPQLYMIEPSGLSYKYFGAALGKGRQAAKTEIEKLKLSELTCREGIVEVAKIIYGVHDEAKDKSFELELSWVCDESNRQHEKVPNDLLEQAKAAAQAALEEMDAD

SEQ ID NO: 6595 - protein, 249 aa, Oryza sativa
MSSIGTGYDLSVTTFSPDGRVFQVEYAGKAVDNSGTVVGIKCKDGIVLGVEKLVTSKMILKGSNRRLHSVHRHSGLAVAGLAADGRQIVSRAKSEAASYEKVYGEPMPVKELADRVASYVHLCTLYWWLRPFGCGVILGGYDRDGPQLYMIEPSGLSYKYFGAALGKGRQAAKTEIEKLNLSELTCREGIVEVAKIIYGVHDEAKDKDFELELSWVCDESKRQHEKVPDDLVEQAKAAAQAALEEMDAD

SEQ ID NO: 6596 - protein, 249 aa, Unknown
  Sequence found in Organisms: Secale cereale, Triticum aestivum
MSSIGTGYDLSVTTFSPDGRVFQVEYAGKAVDNSGTIVGIKCKDGIVLGVEKLITSKMILAGSNRRLHSVHRNSGLAVAGLAADGRQVVSRAKSEAANYEKVYGEPMPVKELADRVASYVHLCTLYWWLRPFGCGVILGGYDRDGPQLYMIEPSGLSYKYFGAALGKGRQAAKTEIEKLKLSELTCREGIVEVAKIIYGVHDEAKDKSFELELSWVCDESNRQHEKVPNDLLEQAKAAAQAALEEMDAD

SEQ ID NO: 6597 - protein, 249 aa, Avena sativa
MSSIGTGYDLSVTTFSPDGRVFQVEYAGKAVDNSGTIVGIKCKDGIVLGVEKLITSKMILAGSNRRLHSVHHNSGLAVAGLAADGRQIVSRAKSEAANYEKVYGEPMPVKELADRVASYVHLCTLYWWLRPFGCGVILGGYDRDGPQLYMIEPSGLSYKYFGAALGKGRQAAKTEIEKLKLSELTCREGIVEVAKIIYGVHDEAKDKSFELELSWVCDESNRQHEKVPSDLLEQAKAAAQAALEEMDAD

SEQ ID NO: 6598 - protein, 249 aa, Unknown
  Sequence found in Organisms: Hordeum vulgare, Secale cereale, Triticum aestivum
MSSIGTGYDLSVTTFSPDGRVFQVEYAGKAVDNSGTIVGIKCKDGIVLGVEKLITSKMILAGSNRRLHSVHRNSGLAVAGLAADGRQIVSRAKSEAANYEKVYGEPMPVKELADRVASYVHLCTLYWWLRPFGCGVILGGYDRDGPQLYMIEPSGLSYKYFGAALGKGRQAAKTEIEKLKLSELTCREGIVEVAKIIYGVHDEAKDKSFELELSWVCEESNRQHEKVPSDLLEQAKAAAQAALEEMDAD

SEQ ID NO: 6599 - protein, 249 aa, Avena sativa
MSSIGTGYDLSVTTFSPDGRVFQVEYAGKAVDNSGTIVGIKCKDGIVLGVEKLITSKMILAGSNRRLHSVHHNSGLAVAGLAADGRQIVSRAKSEAANYEKVYGEPMPVKELADRVASYVHLCTLYWWLRPFGCGVILGGYDRDGPQLYMIEPSGLSYKYFGAALGKGRQAAKTEIEKLKLSELTCREGIVEVAKIIYGVHDEAKDKSFELELSWVCDESNRQHEKVPSVLLEQAKAAAQAALEEMDAD

SEQ ID NO: 6600 - protein, 249 aa, Platanus occidentalis
MSSIGTGYDLSVTTFSPDGRVFQIEYAAKAVDNSGTVIGIKCKDGIVMGVEKLIASKMMLPGSNRRIHSVHRHSGMAVAGLAADGRQIVARTKSEANSYESVYGEPIPVKELAERVASYVHLCTLYWWLRPFGCGVILGGYDRDGPQLYMVEPSGVSYRYFGAAIGKGRQAAKTEIEKLKLSEMTCREGVIEVAKIIYGVHDEAKDKAFELEMSWVCDESNRQHQKVPDELLEAAKAAAKAALEEMDAD

SEQ ID NO: 6601 - protein, 249 aa, Tripterygium wilfordii
MSSIGTGYDLSVTTFSPDGRVFQVEYASKAVDNSGTVVGIKCKDGIVMGVEKLIQSKMMLPDSNRRIHSVHRHSGMAVAGLAADGRQIVARAKSEATNYEKVYGEPIPVKELADRVASYVHLCTLYWWLRPFGCGVILGGYDRDGPQLYMVEPSGVSYRYFGAAIGKGRQAAKTEVEKLKLSELTCRQGVIEVAKIIYGVHDEAKDKAFELEMSWICDESNRQHQKIPDDLLEEAKAAAKAALEEMDAD

SEQ ID NO: 6602 - protein, 249 aa, Solanum phureja
MSSIGTGYDLSVTTFSPDGRVFQIEYAGKAVDNSGTVVGIKCKDGIVLGVEKLIASKMMLPGSNRRIHSVHRHSGMAVAGLAADGRQIVSRAKSEATSFESVYGEPIPVKELAERVASYVHLCTLYWWLRPFGCGVILGGYDRDGPQLYVVEPSGVSYRYFGAAIGKGRQAAKTEIEKLKLSEMTCRQGIIEVAKIIYGVHDEAKDKAFELEMSWVCDESNRQHQKVPDNLLEEAKAAAKAALEEMDAD

SEQ ID NO: 6603 - protein, 249 aa, Euonymus alatus
MSSIGTGYDLSVTTFSPDGRVFQVEYASKAVDNSGTVVGIKCKDGIVMGVEKLIQSKMMLPDSNRRIHSVHRHSGMAVAGLAADGRQIVARAKSEATNYEKTYGEPIPVKELADRVASYVHLCTLYWWLRPFGCGVILGGYDRDGPQLYMVEPSGVSYRYFGAAIGKGRQAAKTEVEKLKLSELTCHQGVIEVAKIIYGVHDEAKDKAFELEMSWVCDESNRQHQKVPDELLEEAKAAAKAALEEMDAD

SEQ ID NO: 6604 - protein, 249 aa, Platanus occidentalis
MSSIGTGYDLSVTTFSPDGRVFQIEYAAKAVDNSGTVVGIKCKDGIVMGVEKLIASKMMLPGSNRRIHSVHRHSGMAVAGLAADGRQIVARAKSEATNYESVYGELIPVKELAERVASYVHLCTLYWWLRPFGCGVILGGYDRDGPQLYMVEPSGVSYRYFGAAIGKGRQAAKTEIEKLKLSEMTCREGLIEVAKIIYGVHDEAKDKAFELEMSWVCDESNRQHQKVPDELLEEAKAAAKAALEEMDAD

SEQ ID NO: 6605 - protein, 249 aa, Ananas comosus
MSSIGTGYDLSVTTFSPDGRVFQIEYAAKAVDNSGTVIGIKCKDGVVLGVEKLISSKMMLEGSNRRIHSVHRHSGMAVAGLAADGRQIVARAKSEAASYERVYGEPIPVKELADRVASYVHLCTLYWWLRPFGCGVLLGGYDRDGPQLYMVESSGVSYRYFGAAMGKGRQAAKTEIEKLKLSELTCREGVIEVAKIIYGLHDEAKDKAFELEMSWVCDESNRLHQKVPDNLLEEAKAAAKAALEEMDAD

SEQ ID NO: 6606 - protein, 249 aa, Unknown
  Sequence found in Organisms: Solanum lycopersicum, Solanum tuberosum
MSSIGTGYDLSVTTFSPDGRVFQIEYAGKAVDNSGTVVGIKCKDGIVLGVEKLIASKMMLPGSNRRIHSVHRHSGMAVAGLAADGRQIVARAKSEATSFESVYGEPIPVKELAERVASYVHLCTLYWWLRPFGCGVILGGYDRDGPQLYLVEPSGVSYRYFGAAIGKGRQAAKTEIEKLKLSEMTCRQGIIEVAKIIYGVHDEAKDKAFELEMSWVCDESNRQHQKVPDNLLEEAKAAAKAALEEMDAD

SEQ ID NO: 6607 - protein, 249 aa, Juglans hindsii x Juglans regia
MSSIGTGYDLSVTTFSPDGRVFQIEYAAKAVDNSGTVIGIKCKDGIVLGVEKLITSKMMLPGSNRRIHSVHRHSGMAVAGLAADGRQIVARAKSEATNYESVYGEPIPVKELADRVASYVHLCTLYWWLRPFGCGVILGGYDRDGPQLYMVEPSGVSYRYFGAAIGKGRQAAKTEIEKLRLSELTCRQGVIEVAKIIYGVHDEAKDKEFELEMSWVCDESNRQHQKVPDELLHEAKAAAKAALEEMDAD

SEQ ID NO: 6608 - protein, 249 aa, Elaeis guineensis
MSSIGTGYDLSVTTFSPDGRVFQIEYAAKAVDNSGTVIGIKCKDGIVMGVEKLISSKMMLAGSNRRIHSVHRHSGMAVAGLAADGRQIVARAKSEATSYERVYGEPIPVKELAERVAGYVHLCTLYWWLRPFGCGVLLGGYDRDGPQLYMIEPSGVSYRYFGAAIGKGRQAAKTEIEKLKLSELTCREGVIEVAKIIYGVHDEAKDKAFELEMSWVCDESNRQQQKVPDDLLEEAKAAAKAALEEMDAD

SEQ ID NO: 6609 - protein, 249 aa, Phalaenopsis aphrodite
MSSIGTGYDLSVTTFSPDGRVFQIEYAAKAVDNSGTVVGIRCKDGIVLGVEKLISSKMMLAGSNRRIHSVHRHSGMAVSGLAADGRQIVARAKSEATNYERTYGEPIPVKELADRVASYVHLCTLYWWLRPFGCGVILGGYDRDGPQLYIVEPSGVSYRYFGAAIGKGRQAAKTEIEKLKLSELTCRQGVVEVAKIIYGVHDEAKDKAFELELSWVCEESNRQHQKVPEDLLEEAKAAAIAALEEMDAD

SEQ ID NO: 6610 - protein, 249 aa, Unknown
  Sequence found in Organisms: Citrus sinensis, Citrus clementina, Citrus sinensis
MSSIGTGYDLSVTTFSPDGRVFQIEYAAKAVDNSGTVIGIKCKDGIVMGVEKLIASKMMLPGSNRRIHSVHRHSGMAVAGLAADGRQIVTRAKSEATNYESVYGEPIPVKELAQRVASYVHLCTLYWWLRPFGCGVILGGYDRDGPQLYMIEPSGISYRYFGAAIGKGRQAAKTEIEKLKLSEMTCRQGVIEVAKIIYGVHDEAKDKAFELEMSWVCDESNRQHQKVPDELLEEAKAAARAALEEMDAD

SEQ ID NO: 6611 - protein, 249 aa, Solanum melongena
MSSIGTGYDLSVTTFSPDGRVFQIEYAGKAVDNSGTVVGIKCKDGIVLGVEKLIASKMMLPGSNRRIHSVHRHSGMAVAGLAADGRQIVARAKSEATSFESVYGEPIPVKELAERVASYVHLCTLYWWLRPFGCGVILGGYDRDGPQLYMVEPSGVSYRYFGAAIGKGRQAAKTEIEKLKLSEMSCRQGVIEVAKIIYGVHDEAKDKAFELEMSWVCDESNRQHQKVPDNLLEEAKAAAKAALEEMDAD

SEQ ID NO: 6612 - protein, 249 aa, Unknown
  Sequence found in Organisms: Solanum tuberosum, Solanum phureja
MSSIGTGYDLSVTTFSPDGRVFQIEYAGKAVDNSGTVVGIKCKDGIVLGVEKLIASKMMLPGSNRRIHSVHRHSGMAVAGLAADGRQIVARAKSEATSFESVYGEPIPVKELAERVASYVHLCTLYWWLRPFGSGVILGGYDRDGPQLYMVEPSGVSYRYFGAAIGKGRQAAKTEIEKLKLSEMTCRQGVIEVAKIIYGVHDEAKDKAFELEMSWVCDESNRQHQKVPADLLEEAKAAAKAALEEMDAD

SEQ ID NO: 6613 - protein, 249 aa, Nicotiana tabacum
MSSIGTGYDLSVTTFSPDGRVFQIEYAGKAVDNSGTVVGIKCKDGIVLGVEKLIASKMMLPGSNRRIHSVHRHSGMAVAGLAADGRQIVARTKSEATNYESTYGEPILVKELAERVASYVHLCTLYWWLRPFGCGVILGGYDRDGPQLYMVEPSGVSYRYFGAAIGKGRQAAKTEIEKLKLSEMTCRQGVIEVAKIIYGVHDEAKDKAFELEMSWVCDESNRQHQKVPADLLEEAKAAAKAALEEMDAD

SEQ ID NO: 6614 - protein, 249 aa, Linum usitatissimum
MSSIGTGYDLSVTTFSPDGRVFQIEYAAKAVDNSGTVVGIKCKDGIVMGVEKLIASKMMLPGSNRRIHSVHRHSGMAVAGLAADGRQIVARAKSEAANYDNVYGEPIPVKELADRVASYVHLCTLYWWLRPFGCGVILGGYDRDGPQLYMIEPSGISYRYFGAAIGKGKQAAKTEIEKLKLSEMTCREGILEVAKIIYKVHDEAKDKAFELELSWVCEESKRQHQKVPEELLEEAKSAARTALEEMDAD

SEQ ID NO: 6615 - protein, 249 aa, Elaeis guineensis
MSSIGTGYDLSVTTFSPDGRVFQIEYAAKAVDNSGTVIGIKCKDGIVMGVEKLISSKMMLAGSNRRIHSVHRHSGMAVAGLAADGRQIVTRAKSEATSYERVYGEPIPVKELAERVAGYVHLCTLYWWLRPFGCGVLLGGYDRDGPQLYMIEPSGVSYRYFGTAIGKGRQAAKTEIEKLKLSELTCREGVIEVAKIIYAVHDEAKDKAFELEMSWVCDESNRQHQKVPDDLLEEAKAAAKAALEEMDAD

SEQ ID NO: 6616 - protein, 249 aa, Olea europaea
MSSIGTGYDLSVTTFSPDGRVFQIEYAAKAVDNSGTVVGIKCKDGIVLGVEKLITSKMMLPGSNRRIHAVHRHSGMAVAGLAADGRQIVARAKSEATNYESVYGEPIPVKELAERVASYVHLCTLYWWLRPFGSGVILGGYDRDGPQLYMVEPSGVSYRYFGAAIGKGRQAAKTEIEKLKLSEMTCRQGVIEVAKIIYGVHDEAKDKAFELEMSWVCDESNRQHQKVPDDILEEAKAAAKAALEEMDAD

SEQ ID NO: 6617 - protein, 249 aa, Citrullus lanatus
MSSIGTGYDLSVTTFSPDGRVFQIEYAAKAVDNSGTVIGIKCKDGVVMGVEKLITSKMMLPGSNRRIHAVHRHSGMAVAGLAADGRQIVARAKSEATNYESVYGEPIPVKELADRVASYVHLCTLYWWLRPFGCGVILGGYDRDGPQLYMVEPSGVSYRYYGAAIGKGRQAAKTEIEKLKLSELTCRQGVIEVAKIIYGVHDEAKDKDFELEMSWICDESNRQHQKVPEDLLEEAKAAAKAALEEMDAD

SEQ ID NO: 6618 - protein, 249 aa, Cucumis sativus
MSSIGTGYDLSVTTFSPDGRVFQIEYAAKAVDNSGTVIGIKCKDGVVMGVEKLITSKMMLPGSNRRIHAIHRHSGMAVAGLAADGRQIVARAKSEASNYESVYGEPIPVKELADRVASYVHLCTLYWWLRPFGCGVILGGYDRDGPQLYMVEPSGVSYRYYGAAIGKGRQAAKTEIEKLKLSELTCRQGVIEVAKIIYGVHDEAKDKDFELEMSWICDESNHQHQKVPEDLLEEAKAAAKAALEEMDAD

SEQ ID NO: 6619 - protein, 249 aa, Ipomoea nil
MSSIGTGYDLSVTTFSPDGRVFQIEYAAKAVDNSGTVIGIKCKDGIVMGVEKLIALKMMLPGSNRRIHSVHRHSGMAVAGLAADGRQIVARTKSEATSYANVYGEPIPVKELAERVASYVHLCTLYWWLRPFGCGVILGGYDRDGPQLYMVEPSGVSYRYFGAAIGKGRQAAKTEIEKLKLSEMTCRQGVIEVAKIIYGVHDEAKDKAFELEMSWVCDESNRQHQKVPEDLLEEAKAAAKAALEEMDAD

SEQ ID NO: 6620 - protein, 249 aa, Cucumis melo
MSSIGTGYDLSVTTFSPDGRVFQIEYAAKAVDNSGTVIGIKCKDGVVMGVEKLITSKMMLPGSNRRIHAIHRHSGMAVAGLAADGRQIVARAKSEATNYESVYGEPIPVKELADRVASYVHLCTLYWWLRPFGCGVILGGYDRDGPQLYMVEPSGVSYRYYGAAIGKGRQAAKTEIEKLKLSELTCRQGVIEVAKIIYGVHDEAKDKDFELEMSWICDESNHQHQKVPEDLLEEAKAAAKAALEEMDAD

SEQ ID NO: 6621 - protein, 249 aa, Helianthus annuus
MSSIGTGYDLSVTTFSPDGRVFQIEYAAKAVDNSGTVVGIKCKDGIVIGVEKLIASKMMLPGSNRRIHSVHRHSGMGVAGLAADGRQIVARAKSEAHNYESTYGEPIPIKELADRVASYVHLCTLYWWLRPFGSGVILGGYDRDGPQLYMVEPSGVSYRYFGAAIGKGRQAAKTEIEKLKLSELTCREGVIEVAKIIYGVHDEAKDKTFELEMSWVCDESNRQHQKVPEALLEEAKAAAQAALEEMDAD

SEQ ID NO: 6622 - protein, 249 aa, Ambrosia trifida
MSSIGTGYDLSVTTFSPDGRVFQIEYAAKAVDNSGTVVGIKCKDGIVIGVEKLIASKMMLPGSNRRIHSVHRHSGMGVAGLAADGRQIVARAKSEAHNYESTYGEPIPIKELADRVASYVHLCTLYWWLRPFGSGVILGGYDRDGPQLYMVEPSGVSYRYFGAAIGKGRQAAKTEIEKLKLSELTCREGVIEVAKIIYGVHDEAKDKTFELEMSWVCDESNRQHQKVPEALLEEAKAAAKAALEEMDAD

SEQ ID NO: 6623 - protein, 249 aa, Aquilegia formosa
MASIGTGYDLSVTTFSPDGRVFQIEYASKAVDNSGTVIGIKCKDGIVLGVEKLIASKMMLPGSNRRIHAVDRHSGMAVAGLAADGRQIVARTKSEATNYERTYGEPIPVKELADRVASYVHLCTLYWWLRPFGCGVILGGYDRDGPQLYMVEPSGVSYRYFGAAIGKGRQAAKTEIEKLNLSEMTCRQGVVEVAKIIYGVHDEAKDKAFELEMSWVCDESNRLHQKVPDELLEGAKAAAKAALEEMDAD

SEQ ID NO: 6624 - protein, 249 aa, Cucurbita pepo
MSSIGTGYDLSVTTFSPDGRVFQIEYAAKAVDNSGTVIGIKCKDGVVMGVEKLITSKMMLPGSNRRIHAVHRHSGMAVAGLAADGRQIVARAKSEATNYESIYGEPIPVKELADRVASYVHLCTLYWWLRPFGCGVILGGYDRDGPQLYMVEPSGVSYRYYGAAIGKGRQAAKTEIEKLKLSELTCRQGVIEVAKIIYGVHDEAKDKDFELEMSWICDESNRQHQKVPEDLLEEAKAAAKAALEEMDAD

SEQ ID NO: 6625 - protein, 249 aa, Euonymus alatus
MSSIGTGYDLSVTTFSPDGRVFQVEYASKAVDNSGTVIGIKCKDGIVMGVEKLIQSKMMLPDCNRRIHSVHRHSGMAVAGLAADGRQIVARAKSEATNYEKTYGEPIPVKELADRVASYVHLCTLYWWLRPFGCGVILGGYDRDGPQLYMVEPSGVSYRYFGAAIGKGRQAAKTEVEKLKLSELTCRQGVIEVAKIIYGVHDEAKDKAFELEMSWVCDESNRLHQKVPDDLLEEAKAAAKAALEEMDAD

SEQ ID NO: 6626 - protein, 249 aa, Castanea mollissima
MSSIGTGYDLAVTTFSPDGRVFQIEYAAKAVDNSGTVIGIKCKDGIVMGVEKLIASKMMLPGSNRRIHSVHRHSGMAVAGLAADGRQIVARAKSEASNYESTYGEPIPIKELADRVASYVHLCTLYWWLRPFGCGVILGGYDRDGPQLYMVEPSGVSYRYFGAAIGKGRQAAKTEIEKLKLSELTCRQGVIEVAKIIYGVHDEAKDKDFELELSWVCDESNRQHQKVPDELLQEAKAAAKAALEEMDAD

SEQ ID NO: 6627 - protein, 249 aa, Gerbera hybrid cultivar
MSSIGTGYDLSVTTFSPDGRVFQIEYAAKAVDNSGTVVGIKCKDGIVIGVEKLIASKMMLPGSNRRIHSVHRHSGMGVAGLAADGRQIVARAKSEAQNYESVYGEPIPVKELAERVASYVHLCTLYWWLRPFGSGVILGGYDRDGPQLYMVEPSGVSYRYFGAAIGKGRQAAKTEIEKLKLSEMTCRQGVIEVAKIIYGVHDEAKDKSFELEMSWVCDESNHQHQKVPEGLLEEAKAAAKAALEEMDAD

SEQ ID NO: 6628 - protein, 249 aa, Arachis hypogaea
MSSIGTGYDLSVTTFSPDGRVFQIEYAAKAVDNSGTVIGIKCKDGIVLGVEKLIASKMMLPGSNRRIHSVHRHSGMAVAGLAADGRQIVARTKSEATNYDSVYGEPIPVKELAERVASYVHLCTLYWWLRPFGCGVILGGYDRDGPQLYMVEPSGVSYRYFGAAIGKGRQAAKTEIEKLKLTDMTCRQGVIEVAKIIYGVHDEAKDKDFELEMSWVCDESNRQHQKVPDELLEEAKAAAKAALEEMDAD

SEQ ID NO: 6629 - protein, 249 aa, Capsicum annuum
MSSIGTGYDLSVTTFSPDGRVFQIEYAAKAVDNSGTVVGIKCKDGIVLGVEKLIASKMMLPGSNRRIHSVHRHSGMAVAGLAADGRQIVARAKSEATSFESVYGEPIPVKELAERVASYVHLCTLYWWLRPFGCGVILGGYDRDGPQLYLVEPSGVSYRYFGAAIGKGRQAAKTEIEKLKLSEMTCRQGVIEVAKIIYGVHDEAKDKDFELEMSWVCDESNRQHQKVPDNLLEEAKTAAKAALEEMDAD

SEQ ID NO: 6630 - protein, 249 aa, Solanum lycopersicum
MSSIGTGYDLSVTTFSPDGRVFQIEYAGKAVDNSGTVVGIKCKDGIVLGVEKLIASKMMLPGSNRRIHSVHRHSGMAVAGLAADGRQIVARAKSEATSFESVYGEPIPVKELAERVASYVHLCTLYWWLRPFGSGVILGGYDRDGPQLYMVEPSGVSHRYFGAAIGKGRQAAKTEIEKLKLSEMTCRQGVIEVAKIIYGVHDEAKDKAFELEMSWVCDESNRQHQKVPADLLEEAKDAAKAALEEMDAD

SEQ ID NO: 6631 - protein, 249 aa, Tragopogon dubius
MSSIGTGYDLSVTTFSPDGRVFQIEYAAKAVDNSGTVVGIKCKDGIVIGVEKLIASKMMLPGSNRRIHSVHRHSGMGVAGLAADGRQIVARAKSEAQSYESVYGEPIPVKELAERVASYVHLCTLYWWLRPFGSGVILGGYDRDGPQLYMVEPSGVSYRYFGAAIGKGRQAAKTEIEKLKLSEMTCRQGVIEVAKIIYGVHDEAKDKTFELEMSWVCDESNRQHQKVPEALLEEAKAAAKAALEEMDAD

SEQ ID NO: 6632 - protein, 247 aa, Zostera marina
SIGTGYDLSVTTFSPDGRVFQVEYSGKAVDNSGTVVGIKCKDGVVMGVEKLISSKMMLEGSNRRIHAVHRHAGMSVAGLAADGRQIVSRAKSEAISYERVYGEPIPIKELVDRVASYVHLCTLYWWLRPFGCGVILGGFDRDGPQLYMIEPSGVSYKYFGAAIGKGRQAAKTEIEKLKLSEMTCREGIIEVAKIIYGVHDEAKDKAFELELSWICEESNHKHQKIPDELIEHAKEAAKTALEEMDAD

SEQ ID NO: 6633 - protein, 191 aa, Chelidonium majus
MSSIGTGYDLSVTTFSPDGRVFQIEYAAKAVDNSGTVIGIKCKDGIVLGVEKLIASKMMLPGSNRRIHSVHRHSGMAVAGLAADGRQIVARTKAEAVNHEKTYGEPIPVKELAERVASYVHLCTLYWWLRPFGCGVILGGYDRDGPQLYMVEPSGISHRYFGAAIGKGRQAAKTEIEKLKLSEMTCREGGY

SEQ ID NO: 6634 - protein, 249 aa, Amborella trichopoda
MSSIGTGYDLSVTTFSPDGRVFQIEYAAKAVDNSGTVIGIKCKDGIVLGVEKLVASKMMLAGSNRRIHSVHRHSGMAVAGLAADGRQIVARAKSEAINYESVYGEPIPVKELAERVASYVHLCTLYWWLRPFGCGVILGGYDREGPQLYMVEPSGVSYRYFGAAIGKGRQGAKTEIEKLKLSEMSCREGVIEVAKIIYGVHDEAKDKAFELEMSWICDESNRQHQKIPDDLLEAAKAAAKAAQDEMDAD

SEQ ID NO: 6635 - protein, 249 aa, Amorphophallus konjac
MSSIGTGYDLSVTTFSPDGRLFQIEYAAKAVDNSGTVVGIKCKDGIVMGVEKLISSKMMLAGSNRRIHSVHRHSGMAVAGLAADGRQIVTRAKGEATNYERVYGEPIPVKELAERVASYVHLCTLYWWLRPFGCGVILGGYDRDGPQLYMVEPSGVSHRYFGAAIGKGRQAAKTEIEKLKLSELTCREGVIEVAKIIYGVHDEAKDKAFELEMSWVCDESNRQHQKVPDDLLEQAKEAAKVALEEMDAD

SEQ ID NO: 6636 - protein, 249 aa, Cucurbita pepo
MSSIGTGYDLSVTTFSPDGRVFQIEYAAKAVDNSGTVIGIKCKDGVVMGVEKLITSKMMLPGSNRRIHAVHRHSGMAVAGLAADGRQIVARAKSEATNYESVYGEPIPVKELADRVASYVHLCTLYWWLRPFGCGVILGGYDRDGPQLYMVEPSGVSYRYYGAAIGKGRQAAKTEIEKLKLSEMTCRQGVIEVAKIIYGVHDEAKDKDFELEMSWICDESNRQHQKVPEDLLGEAKAAAKAALEEMDAD

SEQ ID NO: 6637 - protein, 249 aa, Lippia dulcis
MSSIGTGYDLSVTTFSPDGRVFQIEYAAKAVDNSGTVVAIRCKDGIVMGVEKLIASKMLLPGSNRRIHSVHRHSGMAVAGLAADGRQIVTRAKSEATNYEKVYGEAIPVKELAERVASYVHLCTLYWWLRPFGCGVIVGGYDRDGPQLYMIEPSGISYRYFGAAIGKGRQAAKTEIEKLKLSEMTCRQGIIEVAKIIYGVHDEAKDKAFELEMSWVCDESNRQHQKVPENLLEEAKAAAKAALEEMDAD

SEQ ID NO: 6638 - protein, 249 aa, Aquilegia formosa
MASIGTGYDLSVTTFSPDGRVFQIEYASKAVDNSGTVIGIKCKDGIVMGVEKLIASKMMLPGSNRRIHAVDRHSGMAVAGLAADGRQIVARTKSEATNYERTYGEPIPVKELADRVASYVHLCTLYWWLRPFGCGVILGGYDRDGPQLYMVEPSGVSYRYFGAAIGKGRQAAKTEIEKLNLSEMTCRQGVVEVAKIIYGVHDEAKDKAFELEMSWVCDESNRLHQKVPDELLEGAKAAAKAALEEMDAD

SEQ ID NO: 6639 - protein, 249 aa, Cichorium intybus
MSSIGTGYDLSVTTFSPDGRVFQIEYAAKAVDNSGTVVGIKCKDGIVIGVEKLIGSKMMLPGSNRRIHSVHRHSGMGVAGLAADGRQIVARAKSEAQNYESTYGEPIPVKELAERVASYVHLCTLYWWLRPFGSGVILGGYDRDGPQLYMVEPSGVSYRYFGAAIGKGRQAAKTEIEKLKLSELTCRQGVIEVAKIIYGVHDEAKDKTFELEMSWVCDESNRQHQKVPEALLEEAKAAAKAALEEMDAD

SEQ ID NO: 6640 - protein, 249 aa, Capsicum annuum
MSSIGTGYDLSVTTFSPDGRVFQIEYAGKAVDNSGTVVGIKCKDGIVLGVEKLIASSMMLPGSNRRIHSVHRHSGMAVAGLAADGRQIVARAKSEATNFESTYGEPIPVKELAGRVASYVHLCTLYWWLRPFGCGVILGGYDRDGPQLYMIEPSGVSYRYFGAAIGKGRQAAKTEIEKLKLSEMTCRQGVIEIAKIIYGVHDEAKDKAFELEMSWVCDESNRQHQKVPADLLEEAKAAAKSALEEMDAD

SEQ ID NO: 6641 - protein, 249 aa, Carthamus tinctorius
MSSIGTGYDLSVTTFSPDGRVFQIEYAAKAVDNSGTVVGIKCKDGIVIGVEKLIASKMMLPGSNRRIHSVHRHSGMGVAGLAADGRQIVARAKSEAHNYESVYGEPIPVKELAERVASYVHLCTLYWWLRPFGSGVILGGYDRDGPQLYMVEPSGVSYRYFGAAIGKGRQAAKTEIEKLKLSEMTCRQGVIEVAKIIYGVHDEAKDKTFELEMSWVCDESNRQHQKVPEALLEEAKAAAKAALEEMDAD

SEQ ID NO: 6642 - protein, 249 aa, Helianthus annuus
MSSIGTGYDLSVTTFSPDGRVFQIEYAAKAVDNSGTVVGIKCKDGIVIGVEKLIASKMMLPGSNRRIHSVHRHSGMGVAGLAADGRQIVARAKSEAHNYESTYGEPIPIKELAERVASYVHLCTLYWWLRPFGSGVILGGYDRDGPQLYMVEPSGVSYRYFGAAIGKGRQAAKTEIEKLKLSELTCRQGVIEVAKIIYGVHDEAKDKTFELEMSWVCDESNRQHQKVPEALLEEAKAAAQAALEEMDAD

SEQ ID NO: 6643 - protein, 609 aa, Aristolochia fimbriata
MPSAVYASTSDAVEASAYLAIEDFLHGSAKGLWDTFWGQEEPMPFSVACLYSSGTGSKFYPAEKAIASGKLGGLCATAIMINKGRHSHAKWDQILELALLRPDVGTQSLESDRRPSLSVLGQALFFAVRILLSRSLNKSNVLYNSNCVFVLLVDSQYGGIVKVEGDVNKLNLDVSNVYDCAAEWIKRYSKISISPVDRIWNKLGNANWGDIGALQALLATFHCISQYSGFPKLSIEDLASEHATRLQNRRSERQLVDTRVNGNGFFRFQQKSFSPEIVEVQEEFAKIESEPMPKLDVGSVLWLEDLDGQKGFEINEILSNGEIPTYSATSVEGGNALLLYVGSPPSQIEPAWEDMSLWYQVQRQTKVLNVMKQREISSKYLPQLVASGRMIHPGQCQKPSAGGNCDHPWCGTPILVTYPIGESMADMVRNGSFGHDEALRCFHDCLSALSVAASAGIRHGDIRPENVIHVTLSVNDPYFVLVGWGHAILEDRDRPTMNLLFSSSYALQEGKLCSASDAESLIYLLYFACGGAVPDLDSVEGALEWRVAVWSRRLIQQKLGEISAVLKAFADYVDSLCGTPYPLDYDIWLKRLRTTINYEDHGKDVGPSG

SEQ ID NO: 6644 - protein, 249 aa, Amsonia hubrichtii
MSSIGTGYDLSVTTFSPDGRVFQIEYAAKAVDNSGTVIGIKCKDGIVLGVEKLIASKMMLPGSNRRIHAVHRHSGMAVAGLAADGRQIVARAKAEATNYESTYGEPIPVKELAERVASYVHLCTLYWWLRPFGCGVILGGYDRDGPQLYMVEPSGVSYRYFGAAIGKGRQAAKTEIEKLNLSGMTCRQGVVEVAKIIYGIHDEAKDKAFELEMSWVCDESNRQHQKVPDELLEEAKAAARAALEEMDAD

SEQ ID NO: 6645 - protein, 249 aa, Malus domestica
MSSIGTGYDLSVTTFSPDGRVFQIEYAAKAVDNSGTVIGIKCKDGVVMGVEKLIASKMMLPGSNRRIHSVHRHSGMAVAGLAADGRQIVARTKSEATNYESVYGEQIPVKELAERVASYVHLCTLYWWLRPFGCGIILGGYDRDGPQLYMVEPSGVSYRYFGAAIGKGRQAAKTEIEKLKLSELTCRQGVIEVAKIIYGIHDEAKDKEFELEMSWVCDESNRLHQKVPDELLEEAKAAAKAALEEMDAD

SEQ ID NO: 6646 - protein, 249 aa, Arnica chamissonis
MSSIGTGYDLSVTTFSPDGRVFQIEYAAKAVDNSGTVVGIKCKDGIVIGVEKLIASKMMLSGSNRRIHSVHRHSGMGVAGLAADGRQIVARAKSEAHNYESTYGEPIPIKELADRVASYVHLCTLYWWLRPFGSGVLLGGYDRDGPQLYMVEPSGVSYRYFGAAIGKGRQAAKTEIEKLKLSELTCRQGVIEVAKIIYGVHDEAKDKTFELEMSWVCDESNRQHQKVPEALLEEAKAAAKAALEEMDAD

SEQ ID NO: 6647 - protein, 249 aa, Arnica chamissonis
MSSIGTGYDLSVTTFSPDGRVFQIEYAAKAVDNSGTVVGIKCKDGIVIGVEKLIASKMMLPGSNRRIHSVHRHSGMGVAGLAADGRQIVARAKSEAHNYESTYGEPIPIKELADRVASYVHLCTLYWWLRPFGSGVILGGYDRDGPQLYMIEPSGVSYRYFGAAIGKGRQAAKTEIEKLKLSELTCRQGVIEVAKIIYGVHDEAKDKTFELEMSWVCDESNRLHQKVPEALLEEAKTAAKAALEEMDAD

SEQ ID NO: 6648 - protein, 249 aa, Catharanthus roseus
MSSIGTGYDLSVTTFSPDGRVFQIEYAAKAVDNSGTVIGIKCKDGIVLGVEKLISSKMMLPGSNRRIHAVHHHSGMAVAGLAADGRQIVARAKAEATNYESTYGEPIPVKELAERVASYVHLCTLYWWLRPFGCGVILGGYDRDGPQLYMIEPSGVSYRYFGAAIGKGRQAAKTEIEKLSLSGMTCRQGVVEVAKIIYGIHDEAKDKAFELEMSWVCDESNRQHQKVPDELLEEAKAAARAALEEMDAD

SEQ ID NO: 6649 - protein, 247 aa, Eschscholzia californica
SIGTGYDLSVTTFSPDGRVFQIEYAAKAVDNSGTVIGIKCKDGIVLGVEKLIQSKMMLPGSNRRIHSVHRHSGMAVAGLAADGRQIVARTKSEAINYEKTYGEPIPVKELAERVASYVHLCTLYWWLRPFGCGVILGGYDRDGPQLYMVEPSGISYRYYGAAIGKGRQAAKTEIEKLKLSEMTCRQGVIEVAKIIYGVHDEAKDKAFELEMSWVCDESNRQHQKVPDELLEEAKTAAKLALEEMDAD

SEQ ID NO: 6650 - protein, 249 aa, Eschscholzia californica
MSSIGTGYDLSVTTFSPDGRVFQIEYAAKAVDNSGTVIGIKCKDGIVLGVEKLIQSKMMLPGSNRRIHSVHRHSGMAVAGLAADGRQIVARTKSEAINYEKTYGEPIPVKELAERVASYVHLCTLYWWLRPFGCGVILGGYDRDGPQLYMVEPSGISYRYYGAAIGKGRQAAKTEIEKLKLSEMTCRQGVIEVAKIIYGVHDEAKDKAFELEMSWVCDESNRLHQKVPDDLLEEAKTAAKLALEEMDAD

SEQ ID NO: 6651 - protein, 249 aa, Helianthus annuus
MSSIGTGYDLSVTTFSPDGRVFQIEYAAKAVDNSGTVVGIKCKDGIVIGVEKLIASKMMLPGSNRRIHSVHRHSGMGVAGLAADGRQIVARAKSEAHNYESTYGEPIPIKELAERVASYVHLCTLYWWLRPFGSGVILGGYDRDGPQLYMVEPSGVSYRYFGAAIGKGRQAAKTEIEKLKLSEMTCRQGVIEVAKIIYGVHDEAKDKTFELEMSWVCDESNRQHQKVPEALLEEAKAAAQAALEEMDAD

SEQ ID NO: 6652 - protein, 249 aa, Ocimum basilicum
MSSIGTGYDLSVTTFSPDGRVFQIEYAAKAVDNSGTVVAIRCKDGVVMGVEKLIASKMMLPGSNRRIHAVHRHSGMAVAGLAADGRQIVTRAKSEANNYESVYGEQIPVKELADRVASYVHLCTLYWWLRPFGCGVILGGYDRDGPQLYMIEPSGISYRYFGAAIGKGRQAAKTEIEKLKLSEMTCRQGVIEVAKIIYGVHDEAKDKAFELELSWVCDESNRQHQKVPDVLLEEAKEAAKAALEEMDAD

SEQ ID NO: 6653 - protein, 249 aa, Manihot esculenta
MSSIGTGYDLSVTTFSPDGRVFQIEYAAKAVDNSGTVIGIKCKDGVVMAVEKLIASKMMLPGSNRRIHSVHRHSGMAVAGLAADGRQIVARAKSEATNYESVYGEPIPVKELAERVASYVHLCTLYWWLRPFGCGVILGGYDRDGPQLYMIEPSGISYKYFGAAIGKGKQAAKTEIEKLKLSEMTCREGVIEVAKIIYKVHDEAKDKAFELEMSWVCDESNRQHQKVPDELLEEAKSAARTALEEMDAD

SEQ ID NO: 6654 - protein, 249 aa, Centaurea maculosa
MSRIGTGYDLSVTTFSPDGRVFQIEYAAKAVDNSGTVVGIKCKDGIVIGVEKLIASKMMLPGSNRRIHSVHRHSGMGVAGLAADGRQIVARAKSEAHNYESTYGEPIPIKELADRVAGYVHLCTLYWWLRPFGSGVILGGYDRDGPQLYMVEPSGVSYRYFGVAIGKGRQAAKTEIEKLKLSELTCREGVIEVAKIIYGVHDEAKDKTFELEMSWVCDESNRQHQKVPEALLEEAKAAAQAALEEMDAD

SEQ ID NO: 6655 - protein, 249 aa, Centaurea maculosa
MSSIGTGYDLSVTTFSPDGRVFQIEYAAKAVDNSGTVVGIKCKDGIVIGVEKLIASKMMLPGSNRRIHSVHRHSGMGVAGLAADGRQIVARAKSEAHNYESVYGEPIPVKELAERVASYVHLCTLYWWLRPFGSGVILGGYDRDGPQLYMVEPSGVSYRYFGAAIGKGRQAAKTEIEKLKLSEMTCRQGVIEVAKIIYGVHDEAKDKTFELEMSWVCDESNRLHQKVPEALLEEAKAAAKAALEEMDAD

SEQ ID NO: 6656 - protein, 249 aa, Coffea canephora
MSSIGTGYDLSVTTFSPDGRVFQIEYAAKAVDNSGTVVGIKCKDGVVLGVEKLIASKMMLPGSNRRIHAVHRHSGMAVAGLAADGRQIVARAKSEATNYESVYGEQIPVKELADRVASYVHLCTLYWWLRPFGCGVILGGYDRDGPQLYMVEPSGVSHRYFGTSIGKGRQAAKTEIEKLKLSEMTCRQGVIEVAKIIYGVHDEAKDKAFELEMSWVCDESNRQHQKVPDDLLEEAKAAAKAALEEMDAD

SEQ ID NO: 6657 - protein, 249 aa, Taraxacum officinale
MSSIGTGYDLSVTTFSPDGRVFQIEYAAKAVDNSGTVVGIKCKDGIVIGVEKLIASKMMLPGSNRRIHSVHRHSGMGVAGLAADGRQIVARAKSEAQNYESTYGEPIPVKELADRVASYVHLCTLYWWLRPFGSGVILGGYDRDGPQLYMVEPSGVSYRYFGAAIGKGRQAAKTEIEKLKLSEMSCRQGVIEVAKIIYGVHDEAKDKTFELEMSWVCDESNRQHQKVPETLLEEAKAAAKAALEEMDAD

SEQ ID NO: 6658 - protein, 249 aa, Vitis vinifera
MSSIGTGYDLSVTTFSPDGRVFQIEYAAKAVDNSGTVIGIKCKDGIVLGVEKLIASKMMLPGSNRRIHSVHRHSGMAVAGLAADGRQIVARAKAEATNYQSVYGEAIPVKELAERVASYVHLCTLYWWLRPFGCGVILGGYDRDGPQLYMVEPSGVSYRYFGAAIGKGRQAAKTEIEKLKLSELSCRQGVIEVAKIIYGVHDEAKDKAFELEMSWVCEESNRQHQKVPDDLLEEAKAAAKAALEEMDAD

SEQ ID NO: 6659 - protein, 249 aa, Lactuca sativa
MSSIGTGYDLSVTTFSPDGRVFQIEYAAKAVDNSGTVVGIKCKDGIVIGVEKLIASKMMLPGSNRRIHSVHRHSGMGVAGLAADGRQIVARAKSEAQNYESTYGEPIPVKELAERVASYVHLCTLYWWLRPFGSGVILGGYDRDGPQLYMVEPSGVSYRYFGAAIGKGRQAAKTEIEKLKLSEMTCRQGVIEVAKIIYGVHDEAKDKTFELEMSWVCDESNRQHQKVPEALLEEAKAAAKAALEEMDAD

SEQ ID NO: 6660 - protein, 249 aa, Liriodendron tulipifera
MSSIGTGYDLSVTTFSPDGRVFQIEYAAKAVDNSGTVIGIKCKDGIVMGVEKLIASKMMLPGSNRRIHSVHRHSGMAVAGLAADGRQIVARAKSEATSYESVYGEPIPVKELADRVASYVHLCTLYWWLRPFGCGVILGGYDRDGPQLYMVEPSGVSYRYFGAAIGKGRQGAKTDIEKLKLSEMTCREGVIEVAKIIYKLHDEAKDKAFELEMSWVCDESKRLHQKVPDDLLEEAKAAAKAALEEMDAD

SEQ ID NO: 6661 - protein, 249 aa, Quercus alba
MSSIGTGYDLAVTTFSPDGRVFQIEYAAKAVDNSGTVIGIKCKDGIVMGVEKLIASKMMLPGSNRRIHAVHRHSGMAVAGLAADGRQIVARAKSEASNYESTYGEPIPIKELADRVASYVHLCTLYWWLRPFGCGVILGGYDRDGPQLYMVEPSGVSYRYFGAAIGKGRQAAKTEIEKLKLSELTCRQGVIEVAKIIYGVHDEAKDKDFELELSWVCDESNRLHQKVPDELLQEAKAAAKAALEEMDAD

SEQ ID NO: 6662 - protein, 247 aa, Petunia hybrida
SIGTGYDLSVTTFSPDGRVFQIEYAAKAVDNSGTVIGIKCKDGIVLGVEKLIASKMMLPGSNRRIHSIHRHSGMAVAGLAADGRQIVARAKSEATNFESVYGEPIPVKELAERVASYVHLCTLYWWLRPFGCGVILGGYDRDGPQLYMVEPSGVSYRYFGAAIGKGRQAAKTEIEKLKLSEMTCRQGVIEVAKIIYGVHDEAKDKAFELEMSWVCDESNRQHQKVPEDLLEEAKAAAKAALEEMDAD

SEQ ID NO: 6663 - protein, 249 aa, Prunus persica
MSSIGTGYDLSVTTFSPDGRVFQIEYAAKAVDNSGTVIGIKCKDGVVMGVEKLIASKMMLPGSNRRIHSVHRHSGMAVAGLAADGRQIVARTKSEANNYESVYGEQIPVKELAERVASYVHLCTLYWWLRPFGCGIILGGYDRDGPQLYMVEPSGISYRYFGAAIGKGRQAAKTEIEKLKLSELTCRQGVIEVAKIIYGIHDEAKDKDFELEMSWVCDESNRQHQKVPDELLEEAKAAARAALEEMDAD

SEQ ID NO: 6664 - protein, 249 aa, Glycine max
MSSIGTGYDLSVTTFSPDGRVFQIEYAAKAVDNSGTVIGIKCKDGVVLGVEKLIPSKMMLPGSNRRIHSVHRHSGMAVAGLAADGRQIVARAKSEATNYDSVYGEPIPVKELADRVASYVHLCTLYWWLRPFGCGVILGGYDRDGPQLYMVEPSGVSYRYFGAAIGKGRQAAKTEIEKLKLADMTCRQGVIEVAKIIYGVHDEAKDKDFELEMSWVCDESNRQHEKVPDELLEEAKAAAKAALEEMDAD

SEQ ID NO: 6665 - protein, 249 aa, Fragaria vesca
MASIGTGYDLSVTTFSPDGRVFQIEYATKAVDNSGTVIGIKCKDGVVMGVEKLIASKMMLPGSNRRIHSVDRHSGMAVAGLAADGRQIVARTKSEATNYENVYGEQIPIKELADRVASYVHLCTLYWWLRPFGCGIILGGYDRDGPQLYMVEPSGVSYKYFGAAIGKGRQSAKTEIEKLKLSELTCRQGVIEVAKIIYGIHDEAKDKDFELEMSWVCDESNHQHQKVPDALLEEAKAAARAALEEMDAD

SEQ ID NO: 6666 - protein, 249 aa, Nicotiana tabacum
MASIGTGYDLSVTTFSPDGRVFQIEYAGKAVDNSGTVVGIKCKDGIVLGVEKLIASKMMLPGSNRRIHSVHRHSGMAVAGLAADGRQIVARAKSEATNFESTYGEPIPVKELAERVASYVHLCTLYWWLRPFGCGVILGGYDRDGPQLYLVEPSGVSYRYFGAAIGKGRQAAKTEIEKLKLSEMTCRQGVIEVAKIIYGVHDEAKDKAFELEMSWICDESNRQHQKVPDDILEEAKTAAKAALEEMDAD

SEQ ID NO: 6667 - protein, 263 aa, Ambrosia trifida
MSSIGTGYDLSVTTFSPDRRVFQIEYAAKAVDNSGTVVGIKCKDGIVIGVEKLIASKMMLPGSNRRIHSVHRHSGMGVAGLAADGRQIVARAKSEAHNYESTYGEPIPIKELADRVASYVHLCTLYWWLRPFGSGVILGGYDRDGPQLYMVEPSGVSYRYFGAAIGKGRQAAKTEIEKLKLSELTCRQGVIEVAKIIYGVHDEAKDKTFELEMSWVCDESNRQHQKVPEALWRKQKQLLKQHWKKWMLIKNNNVKISLHCVSI

SEQ ID NO: 6668 - protein, 165 aa, Fagus grandifolia
MGANCCPGKSEANSYESVYGEPVPIKELADRVASYVHLCTLYWWLRPFGCGVILGGYDRDGPQLYMVEPSGVSYRYFGAAIGKGRQAAKTEIEKLKLSDMTCRQGVIEVAKIIYGVHDEAKDKEFELELSWVCDESNRQHQKVPDELLQEAKAAAKAALEEMDAD

SEQ ID NO: 6669 - protein, 192 aa, Cirsium arvense
MMLPGSNRRIHSVHRHSGMGVAGLAADGRQIVARAKSEANNYESTYGEPIPVKELAERVASYVHLCTLYWWLRPFGSGVILGGYDRDGPQLYMVEPSGVSYRYFGAAIGKGRQAAKTEIEKLKLSEMTCRQGVIEVAKIIYGVHDEAKDKTFELEMSWVCDESNRQHQKVPEALLEEAKAAAKAALEEMDAD

SEQ ID NO: 6670 - protein, 249 aa, Malus domestica
MSSIGTGYDLSVTTFSPDGRVFQIEYAAKAVDNSGTVIGIKCKDGVVMGVEKLIASKMMLPGSNRRIHSVHRHSGMAVAGLAADGRQIVARTKSEATNYESVYGEQIPVKELAERVASYVHLCTLYWWLRPFGCGIILGGYDRDGPQLYMVEPSGVSYRYFGAAIGKGRQAAKTEIEKLKLSELTCRQGVIEVAKIIYGIHDEAKDKEFELEMSWVCDESNRLHQKVPDELLEEAKAAAKAALEDMDAD

SEQ ID NO: 6671 - protein, 249 aa, Rosa hybrid cultivar
MSSIGTGYDLSVTTFSPDGRVFQIEYATKAVDNSGTVIGIKCKDGVVMGVEKLIASKMMLPGSNRRIHSVHRHSGMAVAGLAADGRQIVARTKSEATNYENVYGDQIPIKELAERVASYVHLCTLYWWLRPFGCGIILGGYDRDGPQLYMVEPSGVSYRYFGAAIGKGRQAAKTEIEKLKLSELTCRQGVIEVAKIIYGIHDEAKDKDFELEMSWVCDESNRLHQKVPDELLEEAKAAARAALEEMDAD

SEQ ID NO: 6672 - protein, 249 aa, Helianthus annuus
MSSIGTGYDLSVTTFSPDGRVFQIEYAAKAVDNSGTVVGIKCKDGIVIGVEKLIASKMMLPGSNRRIHSVHRHSGMGVAGLAADGRQIVARAKSEAHNYESTYGEPIPIKELAERVASYVHLCTLYWWLRPFGSGVILGGYDRDGPQLYMVEPSGVSYRYYGAAIGKGRQAAKTEIEKLKLSEMTCRQGVIEVAKIIYGVHDEAKDKTFELEMSWVCDESNRQHQKVPEALLEEAKAAAQAALEEMDAD

SEQ ID NO: 6673 - protein, 249 aa, Tabernaemontana elegans
MSSIGTGYDLSVTTFSPDGRVFQIEYAAKAVDNSGTVIGIKCKDGIVLGVEKLIASKMMLPGSNRRIHAVHRHSGMAVAGLAADGRQIVARAKAEATNYESTYGEPIPVKELAERVASYVHLCTLYWWLRPFGCGVILGGYDRDGPQLYVVEPSGVSYRYFGAAIGKGRQAAKTEIEKLNLSEMTCRQGVVEVAKIIYGIHDEAKDKAFELEMSWVCDESNHQHQKVPDKLSEEAKAAARAALEEMDAD

SEQ ID NO: 6674 - protein, 249 aa, Tabernaemontana elegans
MSSIGTGYDLSVTTFSPDGRVFQIEYAAKAVDNSGTVIGIKCKDGVVLGVEKLIASKMMLPGSNRRIHAVHRHSGTAVAGLAADGRQIVARAKAEATSYESTYGEPIPVKELAERVASYVHLCTLYWWLRPFGCGVILGGYDRDGPQLYMIEPSGVSYRYFGAAIGKGRQAAKTEIEKLNLPEMTCRQGVVEVAKIIYGIHDEAKDKAFELEMSWVCDESNRQQQKVPDKLLEEAKAAARAALEEMDAD

SEQ ID NO: 6675 - protein, 249 aa, Vinca minor
MSSIGTGYDLSVTTFSPDGRVFQIEYAAKAVDNSGTVIGIKCKDGVVLGVEKLIASKMMLPGSNRRIHAVHRHSGMAVAGLAADGRQIVARAKSEATNYESTYGEPIPVKELAERVASYVHLCTLYWWLRPFGCGVILGGYDRDGPQLYMVEPSGVSYRYFGAAIGKGRQAAKTEIEKLNLSGMTCRQGVVEVAKIIYGIHDEAKDKAFELEMSWVCDESNRQHQKVPDKLLEEAKAAARAALEEMDAD

SEQ ID NO: 6676 - protein, 249 aa, Cleome spinosa
MSSIGTGYDLSVTTFSPDGRVFQIEYAAKAVDNSGTVVGIKCKDGIVMGVEKLIASKMMLPGSNRRIHSVHRHAGMAVAGLAADGRQIVARAKSEATNYESVYGEAIPLKELSDRVASYVHLCTLYWWLRPFGCGVILGGYDRDGPQLYMVEPSGVSYRYFGAAIGKGKQAAKTEIEKLKLSEMTCREGVVEVAKIIYKLHDEAKDKAFELEMSWICDESKREHQKVPEELLEEAKAAAKTALEEMDAD

SEQ ID NO: 6677 - protein, 249 aa, Mimulus guttatus
MSSIGTGYDLSVTTFSPDGRVFQIEYAAKAVDNSGTVVAIKCKDGVVMGVEKLIASKMMLPGSNRRIHAVHRHSGMAVAGLAADGRQIVTRAKSEATNYESVYGEPIPVKELAARVASYVHLCTLYWWLRPFGCGVILGGYDRDGPQLYMVEPSGISHRYFGAAIGKGRQAAKTEIEKLKLSEMTCRQGVVEVAKIIYGVHDEAKDKAFELEMSWVCDESNRQHQKVPEDLLEEAKSAAKAALEEMDAD

SEQ ID NO: 6678 - protein, 249 aa, Nicotiana benthamiana
MASIGTGYDLSVTTFSPDGRVFQIEYAGKAVDNSGTVVGIKCKDGIVLGVEKLIASKMMLPGSNRRIHSVHRHSGMAVAGLAADGRQIVARAKSEATNFESTYGEPIPVKELAERVASYVHLCTLYWWLRPFGCGVILGGYDRDGPQLYLVEPSGVSYRYFGAAIGKGRQAAKTEIEKLKLSEMTCRQGVIEVAKIIYGVHDEAKDKAFELEMSWICDESNHQHQKVPDDILEEAKTAAKAALEEMDTK

SEQ ID NO: 6679 - protein, 249 aa, Cajanus cajan
MSSIGTGYDLSVTTFSPDGRVFQIEYAAKAVDNSGTVIGIKCKDGVVLGVEKLIPSKMMLPGSNRRIHSVHRHSGMAVAGLAADGRQIVARAKSEATNYDSVYGEPIPVKELAERVASYVHLCTLYWWLRPFGCGVILGGYDRDGPQLYMVEPSGVSYRYFGAAIGKGRQAAKTEIEKLKLADMTCRQGVIEVAKIIYGVHDEAKDKDFELEMSWVCDESNRQHEKVPDELLEEAKAAAKAALEEMDAD

SEQ ID NO: 6680 - protein, 249 aa, Senecio madagascariensis
MSSIGTGYDLSVTTFSPDGRVFQIEYAAKAVDNSGTVVGIKCKDGIVIGVEKLIASKMMLPGSNRRIHSVHRHSGMGVAGLAADGRQIVARAKSEAHNYESTYGEPIPVKELADRVASYVHLCTLYWWLRPFGSGVILGGYDRDGPQLYMIEPSGVSYRYFGAAIGKGRQAAKTEIEKLKLSEMTCRQGVIEVAKIIYGVHDEAKDKTFELEMSWVCDESNRLHQKVPEALLEEAKSAAKLALEEMDAD

SEQ ID NO: 6681 - protein, 249 aa, Glycine max
MSSIGTGYDLSVTTFSPDGRVFQIEYAAKAVDNSGTVIGIKCKDGVVLGVEKLIPSKMMLPGSNRRIHSVHRHSGMAVAGLAADGRQIVARAKSEATNYDSVYGEPIPVKELADRVASYVHLCTLYWWLRPFGCGVILGGYDRDEPQLYMVEPSGVSYRYFGAAIGKGRQAAKTEIEKLKLADMTCRQGLIEVAKIIYGVHDEAKDKDFELEMSWVCDESNRQHEKVPDELLELAKAAAKAALEEMDAD

SEQ ID NO: 6682 - protein, 249 aa, Nicotiana tabacum
MASIGTGYDLSVTTFSPDGRVFQIEYAGKAVDNSGTVVGIKCKDGIILGVEKLIASKMMLPGSNRRIHSVHRHSGMAVAGLAADGRQIVARAKSEATNFESAYGEPIPVKELAERVASYVHLCTLYWWLRPFGCGVILGGYDRDGPQLYLVEPSGVSYRYFGAAIGKGRQAAKTEIEKLKLSEMTCRQGVIEVAKIIYGVHDEAKDKAFELEMSWICDESNRQHQKVPDDILEEAKTAAKAALEEMDAD

SEQ ID NO: 6683 - protein, 248 aa, Juglans hindsii x Juglans regia
MSSIGTGYDLSVTTFSPDGRVFQIEYAAKAVDNSGTVIGIKCKDGIVMGVEKLIASKMMLPGSNRRIHSVHRHSGMAVAGLAADGRQIVARAKSEATNYESVYGEPIPVKELADRVASYVHLCTLYWWLRPFGCGVILGGYDRDGPQLYMVEPSGISYRYFGAAIGKGRQAAKTEIEKLRLSDLTCRQGVIEVAKIIYGVHDEAKDKDFELEMSGVCDESNRQHQKVPEELLHEAKAAAKAALEEMDA

SEQ ID NO: 6684 - protein, 249 aa, Cannabis sativa
MSSIGTGYDLSVTTFSPDGRVFQIEYAAKAVDNSGTVIGIKCKDGVVMGVEKLVASKMMLPGSNRRIHSVHRHSGMAVAGLAADGRQIVARAKSEATNYESLYGEAIPVKELAERVASYVHLCTLYWWLRPFGCGIILGGYDRDGPQLYMIEPSGVSYRYFGAAIGKGRQAAKTEIEKLNLSEMTCRQGIVEVAKIIYGIHDEAKDKGFELEMSWVCEESNRQHQKVPEDLLEEAKSAAKAALEEMDAD

SEQ ID NO: 6685 - protein, 249 aa, Unknown
  Sequence found in Organisms: Gossypium hirsutum, Gossypium raimondii
MSSIGTGYDLSVTTFSPDGRVFQIEYASKAVDNSGTVIGIKCKDGIVMGVEKLIASKMMLPGSNRRILSVHRHSGMAVAGLAADGRQIVARAKSEATSYQSVYGEPIPVKELAERVASYVHLCTLYWWLRPFGCGVILGGYDRDGPQLYMVEPSGISYRYFGAAVGKGKQAAKTEIEKLKLSEMTCREGVIEVAKIIYKVHDEAKDKAFELEMSWVCDESKQQHQKVPDDLLEEAKAAARVALEEMDAD

SEQ ID NO: 6686 - protein, 249 aa, Fagopyrum esculentum
MSSIGTGYDLSVTTFSPDGRVFQIEYAAKAVDNSGTVVGIKCKDGVVLGVEKLIQSKMMLPGSNRRIHSVHRHSGVAVAGLAADGRQIVVRAKSEASNYESLYGEPIPTKELAQRVASYVHLSTLYWWLRPFGSGVILGGYDKDGPELYMVEPSGISYKYFGAAIGKGKQAAKTEIEKLKLSEMTCREGIIEVAKIIYKVHDEAKDKAFELEMSWVCDESNRQHQKVPEDLLETAKAAATAALEEMDAD

SEQ ID NO: 6687 - protein, 249 aa, Flaveria ramosissima
MSSIGTGYDLSVTTFSPDGRVFQIEYAAKAVDNSGTVVGIKCKDGIVIGVEKLIASKMMLPGSNRRIHSVHRHAGMGVAGLAADGRQIVARAKSEAHNYESTYGEPIPIKELADRVASYVHLCTLYWWLRPFGSGVILGGYDRDGPQLYMVEPSGVSYRYFGTAIGKGRQAAKTEIEKLKLSELTCRQGVIEVAKIIYGVHDEAKDKTFELEMSWVCDESNRQHQKVPEALLEEAKEAAKAALEEMDAD

SEQ ID NO: 6688 - protein, 249 aa, Flaveria ramosissima
MSSIGTGYDLSVTTFSPDGRVFQIEYAAKAVDNSGTVLGIKCKDGIVIGVEKLIASKMMLPGFNRRIHSVHRHSGMGVAGLAADGRQIVARAKSEAHNYESTYGEPIPIKELADRVASYVHLCTLYWWLRPFGSGVILGGYDRDGPQLYMVEPSGVSYRYFGAAIGKGRQAAKTEIEKLKLSELTCRQGVIEVAKIIYGVHDDAKDKTFELEMSWVCDESNRQHQKVPEALLEEAKAAAKAALEEMDAD

SEQ ID NO: 6689 - protein, 249 aa, Sarracenia psittacina
MSSIGTGYDLSVTTFSPDGRVFQIEYAAKAVDNSGTVVGITCKDGIVMGVEKLIASKMMLPGSNRRIHSVHRHSGVAVAGLAADGRQIVARTKSEATNYESVYGELIPVKELAERVASYVHLCTLYWWLRPFGCGVILGGYDREGPQLYMIEPSGIAYRYFGAAIGKGKQAAKTEIEKLKLSEMTCREGVIEIAKIIYKVHDEAKDKAFELEMSWICDESKRQHEKVPVELLEEAKAAGKAALEEMDAD

SEQ ID NO: 6690 - protein, 249 aa, Antirrhinum majus
MASIGTGYDLSVTTFSPDGRVFQIEYAAKAVDNSGTVVAIKCKDGVVMGVEKLIASKMMLPGSNRRIHAVHRHSGMAVAGLAADGRQIVARAKSEASNYESVYGEQVPVKELAERVASYVHLCTLYWWLRPFGCGVILGGYDRDGPQLYMIEPSGISYRYFGAAIGKGRQAAKTEIEKLKLSDMTCRQGVIEVAKIIYGVHDEAKDKAFELELSWVCDESNREHQKVPNDLLEEAKAAAKAALEEMDAD

SEQ ID NO: 6691 - protein, 249 aa, Phaseolus coccineus
MSSIGTGYDLSVTTFSPDGRVFQIEYAAKAVDNSGTVIGIKCKDGVVLGVEKLIPSKMMLPGSNRRIHSVHRHSGMAVAGLAADGRQIVARAKSEATNYDSVYGEPIPVKELADRVASYVHLCTLYWWLRPFGCGVILGGYDRDGPQLYMVEPSGVSYRYFGAAIGKGRQAAKTEIEKLKVADMTCRQGVIEVAKIIYGVHDDAKDKDFELEMSWVCDESNRQHEKVPDELLEEAKAAAKAALEEMDAD

SEQ ID NO: 6692 - protein, 249 aa, Theobroma cacao
MSSIGTGYDLSVTTFSPDGRVFQIEYAAKAVDNSGTVIGIKCKDGIVMGVEKLIASKMMLPGSNRRIHSVHRHSGMAVAGLAADGRQIVARAKSEATNYESVYGEPIPVKELAERVASYVHLCTLYWWLRPFGCGVILGGYDRDGPQLYVVEPSGISYRYFGAAIGKGKQAAKTEIEKLKLSEMTCREGVIEVAKIIYKVHDEAKDKAFELEMSWVCDESKQQHQKVPDDLLEEAKAAARTALEEMDAD

SEQ ID NO: 6693 - protein, 249 aa, Trifolium pratense
MSSIGTGYDLSVTTFSPDGRVFQIEYAAKAVDNSGTVIGIKCKDGIVLGVEKLIPSKMMLPGSNRRIHAVHRHSGMAVAGLAADGRQIVARAKSEATNYDSVYGDPIPVKELADRVASYVHLCTLYWWLRPFGCGVILGGYDRDGPQLYMVEPSGVSYRYFGAAIGKGRQAAKTEIEKLKLQDLTCRKAVIEVAKIIYGVHDEAKDKDFELEMSWVCDESNRQHEKVPEELLEEAKAAAKLALEEMDAD

SEQ ID NO: 6694 - protein, 249 aa, Vigna unguiculata
MSSIGTGYDLSVTTFSPDGRVFQIEYAAKAVDNSGTVIGIKCKDGVVLGVEKLIPSKMMLPGSNRRIHSVHRHSGMAVAGLAADGRQIVARAKSEATNYDSVYGEPIPVKELADRVASYVHLCTLYWWLRPFGCGVILGGYDRDGPQLYMVEPSGVSYRYFGAAIGKGRQAAKTEIEKLKLADMTCRQGVIEVAKIIYGVHDEAKDKDFELEMSWVCDDSNRQHVKVPDDLLEEAKAAAKAALEEMDAD

SEQ ID NO: 6695 - protein, 249 aa, Actinidia deliciosa
MSSIGTGYDLSVTTFSPDGRVFQIEYAAKAVDNSGTVVGIKCTDGIVMGVEKLIASKMMLPGSNRRIHSVHRHSGMAVAGLAADGRQIVARAKAEATNYESVYGEPIPVKELAERVASYVHLCTLYWWLRPFGCGIILGGYDRGGPQLYMVEPSGISYRYFGAAIGKGKQAAKTEIEKLKLSEMTCREGIIEIAKIIYKVHDEAKDKAFELEMSWICDESKRQHEKVPEELLEEAKAAAKAALEEMDAD

SEQ ID NO: 6696 - protein, 249 aa, Mimulus guttatus
MSSIGTGYDLSVTTFSPDGRVFQIEYAAKAVDNSGTVVAIKCKDGVVMGVEKLIASKMMLPGSNRRIHAAHRHSGMAVAGLAADGRQIVTRAKSEATNYESVYGEPIPVKELAERVASYVHLCTLYWWLRPFGCGVILGGYDRDGPQLYMIEPSGISYRYFGASIGKGRQAAKTEIEKLKLSDMTCRQGVIEVAKIIYGVHDEAKDKAFELEMSWVCDESNRQHQKVPDNLLEEAKAAAKAALEEMDAD

SEQ ID NO: 6697 - protein, 249 aa, Populus trichocarpa
MSSIGTGYDLSVTTFSPDGRVFQIEYAAKAVDNSGTVIGIKCKDGIVMGVEKLIASKMMLPGSNRRIHTVHRHSGMAVAGLAADGRQIVARAKSEASNYQSVYGEPIPVKELADRVASYVHLCTLYWWLRPFGCGVILGGYDRDGPQLYMVEPSGISYRYFGAAIGKGKQAAKTEIEKLKLSEMTCREGVLEVAKIIYKLHDEAKDKAFELEMSWVCDESKRQHQKVPDELLEGAKAAARIALEEMDAD

SEQ ID NO: 6698 - protein, 249 aa, Zostera marina
MSSIGTGYDLSVTTFSPDGRVFQVEYSGKAVDNSGTVVGIKCKDGVVMGVEKLISSKMMLEGSNRRIHAVHRHAGMSVAGLAADGRQIVSRAKSEAISYERVYGEPIPIKELADRVASYVHLCTLYWWLRPFGCGVILGGFDRDGPQLYMIEPSGVSYKYFGAAIGKGRQAAKTEIEKLNLSEMTCREGILEVAKIIYGVHDEAKDKSFELELSWVCEESNRQHQNIPDDLMEDAKEAAIMAMEEMDAD

SEQ ID NO: 6699 - protein, 249 aa, Beta vulgaris
MSSIGTGYDLSVTTFSPDGRVFQIEYAAKAVDNSGTVVGIKCKDGIVLGVEKLIQSKMMLPGSNRRIHSVHRHSGMAVAGLAADGRQVVARAKSEATNYESTYGEAIPVKELADRVASYVHLCTLYWWLRPFGCGVILGGYDRDGPQLYMVEPSGISYRYFGAAIGKGKQAAKTEIEKLKLSEMSCREGVIEVAKIIYKVHDEAKDKAFELEMSWVCEESKREHQKVPDNLLEQAKAAATAALEEMDAD

SEQ ID NO: 6700 - protein, 249 aa, Fagopyrum esculentum
MSSIGTGYDLSVTTFSPDGRVFQIEYAAKAVDNSGTVVGIKCKDGIVLGVEKLIQSKMMLPDSNRRIHSVHRHSGMAVAGLAADGRQIVARAKSEAMNYESTYGEPIPTSELAQRVASYVHLCTLYWWLRPFGSGVILGGYDRDGPQLYMVEPSGISYRYSGAAIGKGRQAAKTEIEKLKLSEMTCREGVIEVAKIIYKVHDEAKDKAFELELSWVCDESNREHQKVPVDVLETAKAAATAALEEMDAD

SEQ ID NO: 6701 - protein, 249 aa, Silene vulgaris
MSSIGTGYDLSVTTFSPDGRVFQIEYAAKALDNSGTVVGIRCKDGIVMGVEKLIQSKMMLPGSNRRIHSVHRHSGMAVAGLAADGRQVVARAKSEASNYESTYGEPIPVKELADRVASYVHLCTLYWWLRPFGCGVILGGYDRDGPQLYMVEPSGISYRYFGAAIGKGKQAAKTEIEKLKLSEMTCREGIIEVAKIIYKVHDEAKDKAFELELSWICEESKREHQKVPSDLLEAAKTAATTALEEMDAD

SEQ ID NO: 6702 - protein, 249 aa, Vinca minor
MSSIGTGYDLSVTTFSPDGRVFQIEYAAKAVDNSGTVIGIKCKDGVVLGVEKLIASKMMLPGSNRRIHAVHRHSGMAVAGLAADGRQIVARAKAEATNYQSTYGEPIPVKELAERVASYVHLCTLYWWLRPFGCGVILGGYDRDGPQLYMVEPSGVSYRYFGAAIGKGRQAAKTEIEKLNLSGMTCRQGVVEVAKIIYGIHDEAKDKAFELEMSWVCDESNRQHQKVPDELLAEAKAAARAALEEMDAD

SEQ ID NO: 6703 - protein, 249 aa, Theobroma cacao
MSSIGTGYDLSVTTFSPDGRVFQIEYAAKAVDNSGTVIGIKCKDGIVMGVEKLIASKMMLPGSNRRIHSVHRHSGMAVAGLAADGRQIVARAKSEANNYESVYGESIPVKELAARVASYVHLCTLYWWLRPFGCGVILGGYDRDGPQLYMVEPSGISYRYFGAAIGKGKQAAKTEIEKLKLSEMTCREGVIEVAKIIYKVHDEAKDKAFELEMSWVCDESKQQHQKVPDDLLEEAKVAARVALEEMDAD

SEQ ID NO: 6704 - protein, 249 aa, Gossypium hirsutum
MSSIGTGYDLSVTTFSPDGRVFQIEYASKAVDNSGTVIGIKCKDGIVMGVEKLIASKMMLPGSNRRILSVHRHSGMAVAGLAADGRQIVARAKSEATSYQSVYGEPIPVKELAERVASYVHLCTLYWWLRPFGCGVILGGYDRDGPQLYMVEPSGISYRYFGAAVGKGKQAAKTEIEKLKLSEMTCREGVIEVAKIIYKLHDEAKDKAFELEMSWVCDESKQQHQKVPDDLLEEAKAAARIALEEMDAD

SEQ ID NO: 6705 - protein, 249 aa, Panax ginseng
MSSIGTGYDLSVTTFSPDGRVFQIEYAAKAVDNSGTVVAIKCKDGIVMGVEKLIASKMMLPGSNRTIHSVHRHSGMAVAGLAADGRQIVARAKSEANNYQSLYGDQIPVKELCERVASYVHLCTLYWWLRPFGCGVILGGYDREGPQLYMIEPSGVSYKYFGAAIGKGRQAAKTEIEKLKLSEMTCRQGVIEVAKIIYGVHDEAKDKAFELEMSWVCDESKRQHQKVPDEVLEEAKAAAKAALEEMDAD

SEQ ID NO: 6706 - protein, 249 aa, Lotus japonicus
MSSIGTGYDLSVTTFSPDGRVFQIEYAAKAVDNSGTVIGIKCKDGIVLGVEKLIPSKMMLPGSNRRIHSVHRHSGMAVAGLAADGRQIVARAKAEANNYDSTYGEPIPVKELADRVASYVHLCTLYWWLRPFGCGVILGGYDRDGPQLYMVEPSGVSYRYFGAAIGKGRQAAKTEIEKLKLADMTCRQGVIEVAKIIYGVHDEAKDKDFELEMSWVCDESKRQHEKVPDDLLEAAKAAAKAALEEMDAD

SEQ ID NO: 6707 - protein, 249 aa, Tropaeolum majus
MSSIGTGYDLSVTTFSPDGRVFQIEYAAKAVDNSGTVIGIKCKDGIVMGVEKLIASKMMLPGSNRRIHSVHRHAGMAVAGLAADGRQIVARAKSEAASYESVYGEPIPVKELSERVASYVHLCTLYWWLRPFGCGVILGGYDRDGPQLYMIEPSGISYRYFGAAIGKGKQAAKTEIEKLNLSQMTCREGVIEVAKLIYKVHDEAKDKAFELEMSWICDESKRQHQKVPEDLLEEAKNAARVALEEMDAD

SEQ ID NO: 6708 - protein, 249 aa, Orobanche aegyptiaca
MSSIGTGYDLSVTTFSPDGRVFQIEYAAKAVDNSGTVVAIRCKDGMVMGVEKLIASKMVLPGSNRRIHAVHRHSGMAVAGLAADGRQIVARAKSEANSYESVYGEPIPVQELAQRVASYVHLCTLYWWLRPFGSGVILGGYDRDGPQLYVVEPSGVSYRYFGAAIGKGRQAAKTEIEKLKLSEMTCRQGVVEVAKIIYGVHDEAKDKAFELEMSWVCDESNRQHQKVPDDLLEEAKSAAKAALEEMDAD

SEQ ID NO: 6709 - protein, 249 aa, Taxus baccata
MGSIGTGYDLSVTTFSPDGRVFQIEYATKAVDNSGTVIGIKCKDGIVLGVEKLIASKMLLEGSNRRIHAVHRHAGMGVAGLAADGRQIVARAKSEATSYESMYGEPIPVKELCERVASYVHLCTLYWWLRPFGSGVILGGYDRDGPQLYMIEPSGVAYRYFGAAIGKGRQAAKTEIEKLKLSEMTCREGIVEVAKIIYGVHDEAKDKAFELEMSWICDESNRQHEKIPTDLLEEVKALAKAAHEDMDAD

SEQ ID NO: 6710 - protein, 217 aa, Flaveria ramosissima
MSSIGTGYDLSVTTFSPDGRVFQIEYAAKAVDNSGTVVGIKCKDGIVIGVEKLIASKMMLPGSNRRIHSVHRHAGMGVAGLAADGRQIVARAKSEAHNYESTYGEPIPIKELADRVASYVHLCTLYWWLRPFGSGVILGGYDRDGPQLYMVEPSGVSYRYFGTAIGKGRQAAKTEIEKLKLSELTCRQGVIEVAKIIYGVHDEAKEQNVRIGDELGL

SEQ ID NO: 6711 - protein, 249 aa, Cephalotaxus harringtonia
MGSIGTGYDLSVTTFSPDGRVFQIEYATKAVDNSGTVIGIKCKDGIVLGVEKLIASKMLLEGSNRRIHAVHRHAGMGVAGLAADGRQIVARAKSEATSYESMYGEPIPVKELCERVASYVHLCTLYWWLRPFGSGVILGGYDRDGPQLYMIESSGVAYRYFGAAIGKGRQAAKTEIEKLKLSEMTCREGIVEVAKIIYGVHDEAKDKAFELEMSWVCDESNRQHEKIPTDLLEEAKALAKAAHEDMDAD

SEQ ID NO: 6712 - protein, 249 aa, Cicer arietinum
MSSIGTGYDLSVTTFSPDGRVFQIEYAAKAVDNSGTVIGIKCKDGIVLGVEKLIPSKMMLPGSNRRIHAVHRHAGMAVAGLAADGRQIVARAKSEATNYDSVYGDPIPVKELADRVASYVHLCTLYWWLRPFGCGVILGGYDRDGPQLYMVEPSGVSYRYFGAAIGKGRQAAKTEIEKLKLADMTCRQGVIEVAKIIYGVHDEAKDKDFELEMSWVCEESNRQHEKVPEELLQEAKAAAKAALEEMDAD

SEQ ID NO: 6713 - protein, 249 aa, Eucalyptus grandis
MSSIGTGYDLSVTTFSPDGRVFQIEYAAKAVDNSGTVIGIKCKDGIVLGVEKLITSKMMLPGSNRRIHSVHRHSGMAVAGLAADGRQIVARAKAEATQYDGVYGEAIPLKELAGRVANYVHLCTLYWWLRPFGCGVILGGYDRDGPQLYMIEPSGISYRYFGAAIGKGKQAAKTEIEKLKLSEMTCREGVIEVAKIIYKVHDEAKDKAFELEMSWVCDESKRQHEKVPDNLLEEAKAAARLALEEMDAD

SEQ ID NO: 6714 - protein, 249 aa, Euphorbia peplus
MSSIGTGYDLSVTTFSPDGRVFQIEYAAKAVDNSGTVIGIKCKDGIVMGVEKLIASKMMLPGSNRRIHSVHRHSGMAVAGLAADGRQIVARAKSEATNYESVYGEPIPVKELAERVASYVHLCTLYWWLRPFGCGVILGGYDREGPQLYMVEPSGISYRYFGAAIGKGKQAAKTEIEKLKLSEMTCREGVIEVAKIIYKVHDEAKDKAFELEMSWVCDESKRLHQKVPDDLLEEAKTAARTALEEMDAD

SEQ ID NO: 6715 - protein, 249 aa, Unknown
  Sequence found in Organisms: Gossypium hirsutum, Gossypium raimondii
MSSIGTGYDLSVTTFSPDGRVFQIEYAAKAVDNSGTVIGIKCKDGIVMGVEKLIASKMMLPGSNRRIHSVHRHSGMAVAGLAADGRQIVARAKSEATNYQSVYGEPIPVKELAERVASYVHLCTLYWWLRPFGCGIILGGYDRDGPQLYMVEPSGISYRYFGAAIGKGKQAAKTEIEKLKLSEMTCREGVIEVAKIIYKVHDEAKDKAFELEMSWVCDESKQQHQKVPDDLLEEAKVAARTALEEMDAD

SEQ ID NO: 6716 - protein, 249 aa, Lippia dulcis
MSSIGTGYDLSVTTFSPDGRVFQIEYAAKAVDNSGTVVAIRCKDGVVMGVEKLIASKMMLPGSNRRIHAVHRHSGMAVAGLAADGRQIVTRAKSEATNYENVYGEPIPVQELAARVASYVHLCTLYWWLRPFGCGVILGGYDRDGPQLYMVEPSGISYRYFGAAIGKGRQAAKTEIEKLKLSDMTCRQGVIEVAKIIYGVHDEAKDKAFELEMSWVCDESNRQHQKVPDDLLEAAKTAAKAALEEMDAD

SEQ ID NO: 6717 - protein, 249 aa, Plantago ovata
MSSIGTGYDLSVTTFSPDGRVFQIEYAAKAVDNSGTVVAIRCKDGVVMGVEKLIASKMMLPGSNRRIHSVHRHSGMAVAGLAADGRQIVARAKSEASNYESTYGDQIPVKELAERVASYVHLCTLYWWLRPFGCGIILGGYDRDGPQLYMVEPSGVSYRYFGAAIGKGRQAAKTEIEKLKLSEITCRQGAIEVAKIIYGVHDEAKDKAFELELSWVCDESNRLHQKVPEDLLEEAKDAAKAALEEMDAD

SEQ ID NO: 6718 - protein, 249 aa, Papaver somniferum
MSSIGTGYDLSVTTFSPDGRVFQIEYASKAVDNSGTVIGIKCKDGIVLGVEKLVASKMMLPGSNRRIHAVHRHSGMAVAGLAADGRQIVARTKAEAINYEKTYGEAIPVKELAERVASYVHLCTLYWWMRPFGCGVILGGYDRDGPQLYMVEPSGISHRYYGAAIGKGRQAAKTEIEKLNLSEMSCREGIVEVAKIIYSVHDEAKDKAFELEMSWVCDESNRLHQKVPEELLEQAITMAKAALEEMDAD

SEQ ID NO: 6719 - protein, 249 aa, Trigonella foenum-graecum
MSSIGTGYDLSVTTFSPDGRVFQIEYAGKAVDNSGTVIGIRCKDGVVLGVEKLIPSKMMLSGSNRRIHAVHRHSGMAVAGLAADGRQIVARAKSEATNYDSVYGDPIPVKELADRVASYVHLCTLYWWLRPFGCGVILGGYDRDGPQLYMVEPSGVSYRYFGAAIGKGRQAAKTEIEKLKLADMTCRQGVIEVAKIIYGVHDEAKDKDFELEMSWVCDESNRQHEKVPEELLEEAKAAAKLALEEMDAD

SEQ ID NO: 6720 - protein, 249 aa, Medicago truncatula
MSSIGTGYDLSVTTFSPDGRVFQIEYAAKAVDNSGTVIGIRCKDGIVLGVEKLIPSKMMLSGSNRRIHAVHRHSGMAVAGLAADGRQIVARAKSEATNYDSVYGDPIPVKELADRVASYVHLCTLYWWLRPFGCGVILGGYDRDGPQLYMVEPSGVSYRYFGAAIGKGRQAAKTEIEKLKLADMTCRQGVIEVAKIIYGVHDEAKDKDFELEMSWVCDESNRQHEKVPEELLEEAKTAAKLALEEMDAD

SEQ ID NO: 6721 - protein, 249 aa, Tropaeolum majus
MSSIGTGYDLSVTTFSPDGRVFQIEYAAKAVDNSGTVIGIKCKDGIVMGVEKLIASKMMLPGSNRRIHAVHRHAGMAVAGLAADGRQIVARAKSEAASYESVYGEPIPVKELSERVASYVHLCTLYWWLRPFGCGVILGGYDRDGPQLYMIEPSGISYRYFGAAIGKGKQAAKTEIEKLNLSEMTCREGVIEVAKLIYKVHDEAKDKAFELEMSWVCDESKRQHQKVPDDLLEEAKNAARVALEEMDAD

SEQ ID NO: 6722 - protein, 249 aa, Sciadopitys verticillata
MGSIGTGYDLSVTTFSPDGRVFQIEYATKAVDNSGTVIGIRCKDGIVLGVEKLIASKMLLEGSNRRIHAVHRHAGMAVAGLAADGRQIVARAKSEATSYEGLYGEPIPVKELCERVASYVHLCTLYWWLRPFGSGVILGGYDRDGPQLYMIEPSGVAYRYFGAAIGKGRQAAKTEIEKLKLSELTCRQGVVEVAKIIYGVHDEAKDKAFELEMSWICDESNRQHEKIPADLLEEAKVLAKAAHEDMDAD

SEQ ID NO: 6723 - protein, 249 aa, Tamarix hispida
  misc_feature (23)..(23): Xaa can be any naturally occurring amino acid
  misc_feature (185)..(185): Xaa can be any naturally occurring amino acid
MSSIGTGYDLSVTTFSPDGRVFXIEYAAKAVDNSGTVVAIKCKDGVVMGVEKLIQSKMMLPGSNRRIHSVHRHSGMAVAGLAADGRQIVARAKAEATNYESLYGEPIPVKELAGRVASYVHLCTLYWWLRPFGCGVILGGYDRDGPQLYMVEPSGISYKYFGAAIGKGKQAAKTEIEKMKLSEMXCREGAIEVAKIIYKVHDEAKDKAFELELSWVCDESNRQHQKVPAELLEEAKSAAAVALEEMDAD

SEQ ID NO: 6724 - protein, 249 aa, Cedrus atlantica
MGSIGTGYDLSVTTFSPDGRVFQIEYATKAVDNSGTVIGIKCKDGIVLGVEKLIASKMLLEGSNRRIHAVHNHAGMAVAGLAADGRQIVARAKSEATSYENTYGEPIPIKELCERVASYVHLCTLYWWLRPFGSGVILGGYDRDGPQLYMIEPSGVAYRYFGTAIGKGRQAAKTEIEKLKLSEMTCREGVIEVAKIIYGVHDEAKDKAFELEMSWICDESKRQHQKVPADLLEEAKEAAKAAQEDMDAD

SEQ ID NO: 6725 - protein, 249 aa, Unknown
  Sequence found in Organisms: Euphorbia peplus, Euphorbia esula
MSSIGTGYDLSVTTFSPDGRVFQIEYAAKAVDNSGTVIGIKCKDGIVMGVEKLIASKMMLPGSNRRIHSVHRHSGMAVAGLAADGRQIVARAKSEATNYESTYGEPVPVKELAERVASYVHLCTLYWWLRPFGCGVILGGYDREGPQLYMVEPSGISYRYFGAAIGKGKQAAKTEIEKLKLSEMTCREGVIEVAKIIYKVHDEAKDKAFELELSWVCDESKRLHQKVPDDILEEAKAAARTALEEMDAD

SEQ ID NO: 6726 - protein, 249 aa, Unknown
  Sequence found in Organisms: Gossypium hirsutum, Gossypium raimondii
MSSIGTGYDLSVTTFSPDGRVFQIEYAAKAVDNSGTVIGIKCKDGIVMGVEKLIASKMMLPGSNRRIHSVHRHSGMAVAGLAADGRQIVARAKSEATNYQSVYGEPIPVKELAERVASYVHLCTLYWWLRPFGCGIILGGYDRDGPQLYMVEPSGISYRYFGAAIGKGKQAAKTEIEKLNLSEMTCREGVIEVAKIIYKVHDEAKDKAFELEMSWVCDESKQQHQKVPDDLLEEAKVAARTALEEMDAD

SEQ ID NO: 6727 - protein, 249 aa, Podocarpus macrophillus
MGSIGTGYDLSVTTFSPDGRVFQIEYATKAVDNSGTVIGIKCKDGIVLGVEKLIASKMLLEGSNRRIHAVHRHAGMGVAGLAADGRQIVARAKSEASNYENLYGEPIPVKELCERVASYVHLCTLYWWLRPFGSGVILGGYDRDGPQLYMIEPSGVAYRYFGAAIGKGRQAAKTEIEKLKLSEMTCRQGVVEVAKIIYGVHDEAKDKAFELEMSWICDESNKQHEKIPSGLLEEAKALAKAAHEDMDAD

SEQ ID NO: 6728 - protein, 249 aa, Populus trichocarpa
MSSIGTGYDLSVTTFSPDGRVFQIEYAAKAVDNSGTVIGIKCKDGIVMGVEKLIASKMMLPGSNRRIHAVHRHSGMAVAGLAADGRQIVARAKSEATNYQSVYGEPVPIKELADRVASYVHLCTLYWWLRPFGCGVILGGYDRDGPQLYMVEPSGISYRYFGAAIGKGKQAAKTEIEKLKLSEMTCREGVIEVAKIIYKVHDEAKDKAFELEMSWVCDESKRQHEKVPDDLLEEAKAAARNALEEMDAD

SEQ ID NO: 6729 - protein, 249 aa, Abies balsamea
MGSIGTGYDLSVTTFSPDGRVFQIEYATKAVDNSGTVIGIKCKDGIVLGVEKLIASKMLLEGSNRRIHAVHNHAGMAVAGLAADGRQIVARAKSEATSYENTYGEPIPIKELCERVASYVHLCTLYWWLRPFGSGVILGGYDRDGPQLYMIEPSGVAYRYFGTAIGKGRQAAKTEIEKLKLSEMTCRQGVIEVAKIIYGVHDEAKDKAFELEMSWICDESKKQHQKVPADLLEEAKEAAKAAQEDMDAD

SEQ ID NO: 6730 - protein, 249 aa, Brassica napus
MSSIGTGYDLSVTTFSPDGRVFQIEYAAKAVDNSGTVVGIKCKDGIVMGVEKLIASKMMLPGSNRRIHSVHRHAGMAVAGLAADGRQIVARAKSEARSYESVYGDAVPVKELSERVASYVHLCTLYWWLRPFGCGVILGGYDRDGPQLYMIEPSGISYRYFGAAIGKGKQAAKTEIEKLKLSEMTCREGVIEVAKIIYKLHDEAKDKAFELEMSWICEESKREHQKVPDDLLEEAKTAAKTALEEMDAD

SEQ ID NO: 6731 - protein, 249 aa, Distylium racemosum
MGSIGTGYDLSVTTFSPDGRVFQIEYATKAVDNSGTVIGIKCKDGIVLGVEKLIASKMLLEGSNRRIHAVHRHAGMAVAGLAADGRQIVARAKSEATNYEGLYGEPIPVKELCERVASYVHLCTLYWWLRPFGSGVILGGYDREGPQLYMIEPSGVAYRYFGAAIGKGRQAAKTEIEKLKLSEMTCRQGVVEVAKIIYGVHDEAKDKAFELEMSWICDESNRQHEKIPSDLLEEAKVLAKAAHEDMDAD

SEQ ID NO: 6732 - protein, 249 aa, Euphorbia peplus
MSSIGTGYDLSVTTFSPDGRVFQIEYAAKAVDNSGTVIGIKCKDGIVMGVEKLIASKMMLPGSNRRIHSVHRHSGMAVAGLAADGRQIVARAKSEATNYESTYGEPVPVKELAERVASYVHLCTLYWWLRPFGCGVILGGYDREGPQLYMVEPSGISYRYFGAAIGKGKQAAKTEIEKLKLSEMTCREGVLEVAKIIYKVHDEAKDKAFELELSWVCEESKRLHQKVPDDILEEAKAAARTALEEMDAD

SEQ ID NO: 6733 - protein, 249 aa, Eutrema parvulum
MSSIGTGYDLSVTTFSPDGRVFQIEYAAKAVDNSGTVVGIKCKDGIVMGVEKLITSKMMLPGSNRRIHSVHHHAGMAVAGLAADGRQIVARAKSEARSYESVYGEAVPVKELSERVASYVHLCTLYWWLRPFGCGVILGGYDRDGPQLYMIEPSGISHRYFGAAIGKGKQAAKTEIEKLKLSEMTCREGVIEVAKIIYKLHDEAKDKAFELEMSWICEESKREHQKVPEDLLEEAKSAAKTALEEMDAD

SEQ ID NO: 6734 - protein, 249 aa, Valeriana officinalis
MSSIGTGYDLSVTTFSPDGRVFQIEYAAKAVDNSGTVVGIRCKDGIVMGVEKLITSKMMLPGSNRRIHSVHRHSGMAVAGLAADGRQIVARAKGEASSYESTYGDQIPVKELTDRVASYVHLCTLYWWLRPFGCGVILGGYDRDGPQLYMIEPSGISYRYLGAAIGKGKQAAKTEIEKLNLSEMTCREGVLEVAKIIYRVHDEAKDKAFELEMSWVCDESNRQHVKVPEDLLGQATDAAKAALEEMDAD

SEQ ID NO: 6735 - protein, 249 aa, Sequoia sempervirens
MGSIGTGYDLSVTTFSPDGRVFQIEYATKAVDNSGTVIGIKCKDGIVLGVEKLIASKMLLEGSNRRIHAVHRHAGMGVAGLAADGRQIVARAKSEATSYESMYGEPIPVKELCERVASYVHLCTLYWWLRPFGSGVILGGYDRDGPQLYMIEPSGVAYRYFGAAIGKGRQAAKTEIEKLKLSEMTCREGVVEVAKIIYGVHDEAKDKAFELEMSWICDESKRQHEKIPTDLLEEAKKLAKEAHEDMDAD

SEQ ID NO: 6736 - protein, 249 aa, Picea glauca
MGSIGTGYDLSVTTFSPDGRVFQIEYATKAVDNSGTVIGIKCKDGIVLGVEKLIASKMLLEGSNRRIHAVHNHAGMAVAGLAADGRQIVARAKSEATSYENTYGEPIPIKELCERVASYVHLCTLYWWLRPFGSGVILGGYDRDGPQLYMVEPSGVAYRYFGTAIGKGRQAAKTEIEKLKLSEMTCREGVIEVAKIIYGVHDEAKDKAFELEMSWICDESKKQHQKVPADLLEEAKEAAKAAQEDMDAD

SEQ ID NO: 6737 - protein, 249 aa, Triphysaria pusilla
MSSIGTGYDLSVTTFSPDGRVFQIEYAAKAVDNSGTVVAIRCKDGVVMGVEKLIASKMMLPGSNRRIHAVHRHSSMAVAGLAADGRQIVARAKSEATNYESVYGEQIPVQELAQRVASYVHLCTLYWWLRPFGCGVILGGYDRDGPQLYMVEPSGVSYRYFGAAIGKGRQAAKTEIEKLKLSEMTCRQGVIEVAKIIYGVHDEAKDKAFELEMSWVCDESNRQQQKVPEDLLEEAKTAAKVALEEMDAD

SEQ ID NO: 6738 - protein, 254 aa, Ambrosia trifida
MSSIGTGYDLSVTTFSPDGRVFQIEYAAKAVDNSGTVVGIKCKDGIVIGVEKLIASKMMLPGSNRRIHSVHRHSGMGVAGLAADGRQIVARAKSEAHNYESTYGEPIPIKELADRVASYVHLCTLYWWLRPFGSGVILGGYDRDGPQLYMVEPSGVSYRYFGAAIGKGRQAAKTEIEKLKLSELTCRQGVIEVAKIIYGVHDEAKDKTFELEMSWVCDESNRQHQKVPETLLEEAKAAAQAALEEWMLIKNNNS

SEQ ID NO: 6739 - protein, 245 aa, Cephalotaxus harringtonia
GTGYDLSVTTFSPDGRVFQIEYATKAVDNSGTVIGIKCKDGIVLGVEKLIASKMLLEGSNRRIHAVHHHAGMGVAGLAADGRQIVARAKSEATSYESMYGEPIPVKELCERVASYVHLCTLYWWLRPFGSGVILGGYDRDGPQLYMIEPSGVAYRYFGAAIGKGRQAAKTEIEKLKLSEMTCREGIVEVAKIIYGVHDEAKDKAFELEMSWVCDESNRQHEKIPTDLLEEAKALAKAAHEDMDAD

SEQ ID NO: 6740 - protein, 249 aa, Arabidopsis lyrata
MSSIGTGYDLSVTTFSPDGRVFQIEYAAKAVDNSGTVVGIKCKDGIVMGVEKLIASKMMLPGSNRRIHSVHRHAGMAVAGLAADGRQIVARAKSEARSYESVYGDAVPVKELSERVASYVHLCTLYWWLRPFGCGVILGGYDRDGPQLYMIEPSGISYRYFGAAIGKGKQAAKTEIEKLNLSEMTCKEGVIEVAKIIYKLHDEAKDKAFELEMSWICDESKREHQKVPDDLLEEAKTAAKTALEEMDAD

SEQ ID NO: 6741 - protein, 227 aa, Zea mays
MILIDQATVFVKRTVVGIKCKDGIVLGVEKLVTSKMMLEGSNRRIHSVHRHSGLVVAGLAADGRQIVSRAKSEAASYEKVYGEPIPVKDLADRVASYVHLCTLYWWLRPFGCGVILGGYDRDGPQLYMIEPSGVSYKYFGAALGKGRQAAKTEIEKLKLSELTCREGIVEVAKIIYGVHDESKDKAFELELSWICDESNRQHQKVPNELLEQAKAAAQAALEEMDAD

SEQ ID NO: 6742 - protein, 249 aa, Pinus taeda
MGSIGTGYDLSVTTFSPDGRVFQIEYATKAVDNSGTVIGIKCKDGIVLGVEKLIASKMLLEGSNRRIHAVHNHAGMGVAGLAADGRQIVARAKSEATSYENTYGEPIPIKELCERVASYVHLCTLYWWLRPFGSGVILGGYDRDGPQLYMIEPSGVAYRYFGTAIGKGRQAAKTEIEKLKLSEMTCREGVIEVAKIIYGVHDEAKDKAFELEMSWICDESKRRHQKVPADLLEEAKEAAKAAQEDMDAD

SEQ ID NO: 6743 - protein, 249 aa, Pseudotsuga menziesii
MGSIGTGYDLSVTTFSPDGRVFQIEYATKAVDNSGTVIGIKCKDGIVLGVEKLIASKMLLEGSNRRIHAVHNHAGMAVAGLAADGRQIVARAKSEATSYQNTYGEPIPIKELCERVASYVHLCTLYWWLRPFGSGVILGGYDRDGPQLYMIEPSGVAYRYFGTAIGKGRQAAKTEIEKLKLSEMTCREGVIEVAKIIYGVHDEAKDKAFELEMSWVCDESKKQHQKVPADLLEEAKEAAKAAQEDMDAD

SEQ ID NO: 6744 - protein, 250 aa, Pteridium aquilinum
MSSIGTGYDLSVTTFSPDGRVFQIEYATKAVDNSGTSVGIKCKDGVVLGVEKLIASKMLLEGSNRRIHSVHRHAGMAMAGLAADGRQIVSRARSEANSYQVNYGEEIPIKELCDRVASYVHLCTLYWWLRPFGTAALLGGYDRDGPQLYMIEPSGVAYRYFGAAVGKGRQAAKTEIEKLKLSEMTCREGVIEVAKIIYSVHDEAKDKAFELEMSWICDESKREHQRVPADLLEQAKAAAKAALEEDMDAD

SEQ ID NO: 6745 - protein, 192 aa, Pinus pinaster
MLLEGSNRRIHAVHNHAGMGVAGLAADGRQIVARAKSEATSYENTYGEPIPIKELCERVASYVHLCTLYWWLRPFGSGVILGGYDRDGPQLYMIEPSGVAYRYFGTAIGKGRQAAKTEIEKLKLSEMTCREGVIEVAKIIYGVHDEAKDKAFELEMSWICDESKRRHQKVPADLLEEAKEAAKAAQEDMDAD

SEQ ID NO: 6746 - protein, 249 aa, Unknown
  Sequence found in Organisms: Brassica napus, Brassica rapa, Raphanus sativus, Thellungiella halophila, Eutrema halophilum
MSSIGTGYDLSVTTFSPDGRVFQIEYAAKAVDNSGTVVGIKCKDGIVMGVEKLIASKMMLPGSNRRIHSVHRHAGMAVAGLAADGRQIVARAKSEARSYESVYGDAVPVKELSERVASYVHLCTLYWWLRPFGCGVILGGYDKDGPQLYMIEPSGISYRYFGAAIGKGKQAAKTEIEKLKLSEMTCKEGVIEVAKIIYKLHDEAKDKAFELEMSWICEESKREHQKVPDDLLEEAKTAAKTALEEMDAD

SEQ ID NO: 6747 - protein, 249 aa, Arabidopsis thaliana
MSSIGTGYDLSVTTFSPDGRVFQIEYAAKAVDNSGTVVGIKCKDGIVMGVEKLIASKMMLPGSNRRIHSVHRHAGMAVAGLAADGRQIVARAKSEARSYESVYGDAVPVKELSERVASYVHLCTLYWWLRPFGCGVILGGYDRDGPQLYMIEPSGISYRYFGAAIGKGKQAAKTEIEKLNLSEMTCKEGVIEVAKIIYKLHDEAKDKAFELEMSWICEESKREHQKVPDDLLEEAKTAAKTALEEMDAD

SEQ ID NO: 6748 - protein, 249 aa, Brassica rapa
MSSIGTGYDLSVTTFSPDGRVFQMEYAAKAVDNSGTVVGIKCKDGIVMGVEKLIASKMMLPGSNRRIHSVHRHAGMAVAGLAADGRQIVARAKSEARSYESVYGDAVPVKELSERVASYVHLCTLYWWLRPFGCGVILGGYDKDGPQLYMIEPSGISYRYFGAAIGKGKQAAKTEIEKLKLSEMTCKEGVIEVAKIIYKLHDEAKDKAFELEMSWICEESKREHQKVPDDLLEEAKTAAKTALEEMDAD

SEQ ID NO: 6749 - protein, 223 aa, Pseudoroegneria spicata
MSSIGTGYDLSVTTFSPDGRVFQVEYAGKAVDNSGTIVGIKCKDGIVLGVEKLITSKMILAGSNRRLHSVHRNSGLAVAGLAADGRQIVSRAKSEAANYEKVYGEPMPVKELADRVASYVHLCTLYWWLRPFGCGVILGGYDRDGPQLYMIEPSGLSYKYFGAALGKGRQAAKTEIEKLKLSELTCREGIVEVAKIIYGVHDEAKDKSFELELSWVCDESNHQ

SEQ ID NO: 6750 - protein, 150 aa, Eragrostis curvula
  misc_feature (29)..(29): Xaa can be any naturally occurring amino acid
  misc_feature (73)..(73): Xaa can be any naturally occurring amino acid
  misc_feature (79)..(79): Xaa can be any naturally occurring amino acid
  misc_feature (82)..(82): Xaa can be any naturally occurring amino acid
  misc_feature (84)..(84): Xaa can be any naturally occurring amino acid
  misc_feature (90)..(90): Xaa can be any naturally occurring amino acid
  misc_feature (93)..(93): Xaa can be any naturally occurring amino acid
  misc_feature (95)..(96): Xaa can be any naturally occurring amino acid
  misc_feature (98)..(98): Xaa can be any naturally occurring amino acid
  misc_feature (103)..(104): Xaa can be any naturally occurring amino acid
  misc_feature (106)..(109): Xaa can be any naturally occurring amino acid
  misc_feature (111)..(111): Xaa can be any naturally occurring amino acid
  misc_feature (126)..(128): Xaa can be any naturally occurring amino acid
  misc_feature (130)..(130): Xaa can be any naturally occurring amino acid
  misc_feature (137)..(137): Xaa can be any naturally occurring amino acid
  misc_feature (147)..(150): Xaa can be any naturally occurring amino acid
MSSIGTGYDLSVTTFSPDGRVFQVEYATXAVDNSGTVVGIKCKDGIVLGVEKLVTSKMMLEGSNRRIHSVHRXSGLAVXGLXAXGRQIVXRAXSXXAXYEKVXXEXXXXKXLADRVASYVHLCTLXXXLXPFGCGVXLGGYDRDGPXXXX

SEQ ID NO: 6751 - protein, 249 aa, Unknown
  Sequence found in Organisms: Raphanus sativus, Eutrema parvulum
MSSIGTGYDLSVTTFSPDGRVFQIEYAAKAVDNSGTVVGIKCKDGIVMGVEKLIASKMMLPGSNRRIHSVHRHAGMAVAGLAADGRQIVARAKSEARSYESVYGDAVPVKELSERVASYVHLCTLYWWLRPFGCGVILGGYDKDGPQLYMIEPSGISHRYFGAAIGKGKQAAKTEIEKLKLSEMTCKEGVIEVAKIIYKLHDEAKDKAFELEMSWICEESKREHQKVPDDLLEEAKTAAKTALEEMDAD

SEQ ID NO: 6752 - protein, 249 aa, Brassica napus
MSSIGTGYDLSVTTFSPDGRVFQIEYAAKAVDNSGTVVGIKCKDGIVMGVEKLIASKMMLPGSNRRIHSVHHHAGMAVAGLAADGRQIVARAKSEARSYESVYGDAVPVKELSERVASYVHLCTLYWWLRPFGCGVILGGYDKDGPQLYMIEPSGISYRYFGAAIGKGKQAAKTEIEKLKLSEMTCKEGVIEVAKIIYKLHDEAKDKAFELEMSWICEESKREHQKVPDDLLEEAKTAAKTALEEMDAD

SEQ ID NO: 6753 - protein, 249 aa, Catharanthus roseus
MSSIGTGYDLSVTTFSPDGRVFQIEYAAKAVDNSGTVIGIKCKDGIVLGVEKLISSKMMLPGSNRRIHAVHHHSGMAVAGLAADGRQIVARAKAEATNYESTYGEPIPVKELAERVASYVHLCTLYWWLRPFGCGVILGGYDRDGPQLYMIEPSGVSYRYFGAAIGKGRQAAKTEIEKLSLSGMTCRQGVVEVAKIIYGIHDEAKDKAFELEMSWVCDESNRQHQKVPDELLEEAQSCSPGLHLREMEA

SEQ ID NO: 6754 - protein, 249 aa, Brassica napus
MSSIGTGYDLSVTTFSPDGRVFQIEYAAKAVDNSGTVVGIKCKDGIVMGVEKLIASKMMLPRSNRRIHSVHRHAGMAVAGLAADGRQIVARAKSEARSYESVYGDAVPVKELSERVASYVHLCTLYWWLRPFGCGVILGGYDKDGPQLYMIEPSGISYRYFGAAIGKGKQAAKTEIEKLKLSEMTCKEGVIEVAKIIYKLHDEAKDKAFELEMSWICEDSKREHQKVPDDLLEEAKTAAKTALEEMDAD

SEQ ID NO: 6755 - protein, 212 aa, Raphanus sativus
MSSIGTGYDLSVTTFSPDGRVFQIEYAAKAVDNSGTVVGIKCKDGIVMGVEKLIASKMMLPGSNRRIHSVHRHAGMAVAGLAADGRQIVARAKSEARSYESVYGDAVPVKELSERVASYVHLCTLYWWLRPFGCGVILGGYDKDGPQLYMIEPSGISYRYFGAAIGKGKQAAKTEIEKLKLSEMTCKEGVIEVAKIIYKLHDEAKDKHLNWR

SEQ ID NO: 6756 - protein, 237 aa, Momordica charantia
MSSIGTGYDLSVTTFSPDGRVFQIEYAAKAVDNSGTVIGIKCKDGVVMGVEKLITSKMMLPGSNRRIHAVHRHSGMAVAGLAADGRQIVARAKSEATNYESVYGEPIPVKELADRVASYVHLCTLYWWLRPFGCGVILGGYDRDGPQLYMVEPSGVSYRYYGAAIGKGRQAAKTEIEKLNLSELSCRQGVIEVAKIIYGVHDEAKDKDFELEMSWICDESKRQHQKVPDDLLEEAKA

SEQ ID NO: 6757 - protein, 256 aa, Triphysaria pusilla
MSSIGTGYDLSVTTFSPDGRVFQIEYAAKAVDNSGTVVAIRCKDGVVMGVEKLISSKMMLPGSNRRIHAVHRHSSMAVAGLAADGRQIVARAKSEATNYESVYGDQIPVQELAQRVASYVHLCTLYWWLRPFGCGVILGGYDRDGPQLYMVEPSGVSYRYFGAAIGKGRQAAKTEIEKLKLSEMTCRQGVIEVAKIIYGVHDEAKDKAFELEMSWVCDESNRQQQKVPEDLLEEAKTAAKAALEEMDADYSYLFPV

SEQ ID NO: 6758 - protein, 202 aa, Brassica napus
MGVEKLIASKMMLPGSNRRIHSVHRHAGMAVAGLAADGRQIVARAKSEARSYESVYGDAVPVKELSERVASYVHLCTLYWWLRPFGCGVILGGYDKDGPQLYMIEPSGISYRYFGAAIGKGKQAAKTEIEKLKLSEMTCKEGVIEVAKIIYKLHDEAKDKAFELEMSWICEESKREHQKVPDDLLEEAKTAAKTALEEMDAD

SEQ ID NO: 6759 - protein, 239 aa, Ambrosia trifida
MSSIGTGYDLSVTTFSPDGRVFQIEYAAKAVDNSGTVVGIKCKDGIVIGVEKLIASKMMLPGSNRRIHSVHRHSGMGVAGLAADGRQIVARAKSEAHNYESTYGEPIPIKELADRVASYVHLCTLYWWLRPFGSGVILGGYDRDGPQLYMVEPSGVSYRYFGAAIGKGRQAAKTEIEKLKLSELTCREGVIEVAKIIYGVHDEAKDKTFELEMSWVCDESNRQHQKVPEALFGGSESCS

SEQ ID NO: 6760 - protein, 232 aa, Acacia harpophylla
MSSIGTGYDLSVTTFSPDGRVFQIEYAAKAVDNSGTVIGIKCKDGIVMGVEKLVPSKMMLPGSNRRIHSVHRHSGMAVAGLAADGRQIVARAKSEATNYESVYGEQIPVKELADRVASYVHLCTLYWWLRPFGCGVILGGYDRDGPQLYMVEPSGVSYRYFGAAIGKGRQAAKTEIEKLKLSDMSCRQGVIEVAKIIYGVHDEAKDKDFELEMSWVCDESNRQHVKVPDELL

SEQ ID NO: 6761 - protein, 239 aa, Allium cepa
  misc_feature (188)..(188): Xaa can be any naturally occurring amino acid
  misc_feature (221)..(221): Xaa can be any naturally occurring amino acid
MSSIGTGYDLSVTTFSPDGRVFQIEYAAKAVDNSGTVVGIKCKDGIVLGVEKLITSKMMLPGSNRRIHSVHRESGMAVAGLAADGRQIVARAKSEATDYERVYGEPMPVKELADRVASYVHLCTLYWWMRPFGCGVILGGYDRDGPQLYMVEPSGVSFRYFGAAIGKGRQAAKTEIEKLKLSEMTCRXGVIEVAKFIYSVHDEAKDKDFELELSWVCDESXRLHQKVPDDILEEARLLA

SEQ ID NO: 6762 - protein, 268 aa, Cynara scolymus
  misc_feature (259)..(259): Xaa can be any naturally occurring amino acid
MSSIGTGYDLSVTTFSPDGRVFQIEYAAKAVDNSGTVVGIKCKDGIVIGVEKLIASKMMLPGSNRRIHSVHRHSGMGVAGLAADGRQIVARAKSEAHNYESVYGEPIPVKELAERVASYVHLCTLYWWLRPFGSGVILGGYDRDGPQLYMVEPSGVSYRYFGAAIGKGRQAAKTEIEKLKLSEMTCRQGVIEVAKIIYGVHDEAKDKTFELEMSWVCDESNRQHQKVPEALLEEAKAAAKAALEEMDADKYIDIVCVCXNLCFKLVLV

SEQ ID NO: 6763 - protein, 232 aa, Fraxinus spp
DGRVFQIEYAAKAVDNSGTVVGIKCKDGIFLGVEKLITSKMMFPGSNRRIHAVHRHSGMAVAGLAADGRQIVARAKSEATNYESVYGEPIPVKELAERVASYVHLCTLYWWLRPFGSGVILGGYDRDGPQLYMVEPSGVSYRYFGAAIGKGRQAAKTEIEKLKLSEMTCRQGVIEVAKIIYGVHDEAKDKAFELEMSWVCDESNHQHQKVPDDILEEAKAAAKAALEEMDAD

SEQ ID NO: 6764 - protein, 250 aa, Marchantia polymorpha
MSSIGTGYDLSVTTFSPDGRVFQIEYATKAIDNSGTVVGIKCKDGIVLGVEKLIASKMLLEGSNRRIHSVNRHSGMAIAGLAADGRQIVTRARAEAGNYLGFYGEEIPTKELCDRVAYYVHLCTLYWWLRPYGSAAILGGYDRDGPQLYMIEPSGVAYRYFGAAVGKGRQAAKTEIEKLKLSQMTCREGVIAVAKIIYNVHDEAKDKAFELEMSWICDESKREHQRVPADLLAEAKAIAKAAQEEDMDAD

SEQ ID NO: 6765 - protein, 216 aa, Antirrhinum majus
  misc_feature (130)..(130): Xaa can be any naturally occurring amino acid
  misc_feature (157)..(157): Xaa can be any naturally occurring amino acid
  misc_feature (161)..(161): Xaa can be any naturally occurring amino acid
  misc_feature (192)..(192): Xaa can be any naturally occurring amino acid
  misc_feature (195)..(195): Xaa can be any naturally occurring amino acid
MASIGTGYDLSVTTFSPDGRVFQIEYAAKAVDNSGTVVAIKCKDGIVMGVEKLIASKMMLPGSNRRIHAVHHHSGMAVAGLAADGRQIVARAKSEATNYENVYGEPIPVKELADRVASYVHLCTLYWWLXPFGCGVILGGYDRDGPQLYMIEPSGIXYRYXGAAIGKGRQAAKTEIEKLKLSEMTCRQGVVXVAXIIYGVHDEAKKGICTGYELGL

SEQ ID NO: 6766 - protein, 253 aa, Musa acuminata
MSSIGTGYDLSVTTFSPDGRVFQIEYAAKAVDNSGTVIGIKCKDGIVMGVEKLISSKMMLAGSNRRIHAVHRHSGMAVAGLAADGRQIVARAKSEATSYERVYGEPIPVKELADRVASYVHLCTLYWWLRPFGSGIILGGYDRDGPQLYMIEPSGVSYRYFGAAIGKGRQAAKTEIEKLKLSEMTCKEGIIEVAKIIYGVHDEAKDKAFELEMSWICDESNRQHQKFQMIYWRKPRQPRKLHWRRWMQIRGTK

SEQ ID NO: 6767 - protein, 202 aa, Utricularia gibba
MGVEKLIASKMMLPGSNRRIHAVHRHSGMAVAGLAADGRQIVARAKAEATNYESAYGEPIPVKELAERVASYVHLCTLYWWLRPFGCGVILGGYDRDGPQLYMIEPSGVSYRYFGAAMGKGRQAAKTEIEKLKLSEMTCRQGVIEVAKIIYGVHDEAKDKAFELELSWVCDESNRQHQKVPDDLLEEAKEAAKAALEEMDAD

SEQ ID NO: 6768 - protein, 377 aa, Sorghum bicolor
MAATTTSRPAAAALPLAVLAAAMVVALAAAGDVVEQQLEVVGSRYPPLAPGLSFDFYKKSCPKAESIVKEFLSSAVRQNVGLAAALIRVHFHDCFVQGCDASVLLDSTPTQPSEQLSPPNLTLRPAAFKAINDIRARLEQACGRVVSCADITALAARESVALGGGPAYKVPLGRRDGLAAASNAAVLAALPSPTSTVPTLLSFLSKINLDVTDLVALSGGHTVGVAHCSSFSNRLFPTQDPTLNKFFAGQLYGTCPTDTTVNTTVNDIRTPNTFDNKYYVDLLNRQGLFTSDQDLLTNATTRPIVTKFAVDQNAFFEQFVYSYVKMGQINVLTGSQGQVRANCSARNAGAAGNGGEDQLPWSDVVETVVDATGSLVL

SEQ ID NO: 6769 - protein, 81 aa, Zea mays
MAMRTALTSLPARLHAPAPPAAMGGRRLLSDGKGRVLSEEERAKESVYIQKMERERQEKLKKRLEQEKADSEKVKSADADK

SEQ ID NO: 6770 - protein, 91 aa, Unknown
  Sequence found in Organisms: Sorghum bicolor, Triticum aestivum
MAMRTALTSLPARLRAPAAPSSAAATGGGLRLLSDGKGRVLSEEERAKETVYIQKMEKERQEKLKKQLEQEKPGADKAKPADADKKAEGST

SEQ ID NO: 6771 - protein, 87 aa, Pennisetum glaucum
MAMRSALTSLPARLRAPSAAAADGGRRLLSDGKGRLLSEEERAKESVYIQKMERERQEKLKKKLEQEKANADKTKPADADKKPEGSN

SEQ ID NO: 6772 - protein, 87 aa, Saccharum officinarum
MAMRTALTSLPARLRDPSSAAATGGLRLLSDGKGRVLSEEERAKESVYIQKMEKERLEKLKKRLEQEKSGADQGKPADADKKAEGSN

SEQ ID NO: 6773 - protein, 89 aa, Panicum virgatum
MAMRSALSSLPARLRVPSAAAAAAPGARRLLSDGKGRVLSEEERAKESVYIQKMERERQEKLKKKLEQEKADADKTKPADSDKKPEGSN

SEQ ID NO: 6774 - protein, 89 aa, Eragrostis curvula
MAMRSALTSLPARLRGPSAPAATATTGRRLLSDGKGRVLSEEERAKESVYIQKMERERQEKLKKKLEQEKTDADKNKPPESDKKPEGSN

SEQ ID NO: 6775 - protein, 87 aa, Cynodon dactylon
AMRSALTSLPARLRNPAAPAAATTGRRLLSDGKGRVLNEEERAKETVYIQKMERERQEKLRKRMEQEKPDADKNKPADSDKKPEGSS

SEQ ID NO: 6776 - protein, 374 aa, Saccharum officinarum
MRRVALSLLLVCAVARAAAAVTDGLLPNGNFEDGPPKSALVNGTVVSGANAIPRWETSGFVEYIESGHKQGDMLLVVPQGAHAVRLGNEASIRQRLAVTRGAYYAITFSAARTCAQAETLNVSVSPEWGVLPMQTIYGSNGWDSYAWAFKAKFDAVTLVIHNPGVEEDPACGPLIDGVAIRALYPPTLAKGNMLKNGGFEEGPYFLPNASWGVLVPPNIEDDHSPLPAWMIVSSKAVKYVDAAHFAVPQGARAVELVGGRESALVQEVRTVPGWNYRLAFAVGDSGDGCTGSMVAEAYAARATVKVPYESKGTGGYKRAVLDFMAIANRTRVVFQSTFYHMKADGTLCGPLVDDASLVGLRKKPAAGRRLLQFL

SEQ ID NO: 6777 - protein, 375 aa, Sorghum bicolor
MRRVALLLLLVCALARAAAVVTDGLLPNGNFEDGPPKSALVNGTVVSGANAIPRWETSGFVEYIESGHKQGDMLLVVPQGAHAVRLGNEASIRQRLAVARGAYYAITFSAARTCAQAEALNVSVSPEWGVLPMQTIYGSNGWDSYAWAFKAKLSTVTLVIHNPGVEEDPACGPLIDGVAIRALYPPTLARGNMLKNGGFEEGPYFLPNASWGVLVPPNIEDDHSPLPGWMIASSKAVKYVDAAHFAVPQGARAVELVGGRESALVQEVRTVPGWSYRLAFAVGDSGDGCTGSMVAEAYAARATVKVPYESKGTGGYKRAVLDFTAVANRTRVVFQSTFYHMKADGTLCGPLVDDASVVGLRKKPAAAGRRLLQFL

SEQ ID NO: 6778 - protein, 372 aa, Panicum virgatum
MRRVALLLLVCAAARAAAVVTDGLLPNGNFEEGPPKSALVNGTVVKGANAIPRWETSGFVEYIESGHKQGDMLLVVPQGAHAVRLGNEASIRQRLAVTRGAYYAITFSAARTCAQAERLNISVSPEWGVLPMQTIYGSNGWDSYAWAFKAKLDAVTLVIHNPGVEEDPACGPLIDGVAIRALYPPRLARGNMLKNGGFEEGPYFLPSTSWGVLVPPNIEDDHSPLPAWMIASSKAVKYVDAAHFRVPQGARAVELVGGRESALVQEVRTVPGWSYRLAFAVGDAGDGCAGPMVAEAFAARATVKVPYESKGTGGYKRAVLDFTAIANRTRVVFQSTFYHMKADGTLCGPLVDDASLVGLRKKPAAGSRRLLL

SEQ ID NO: 6779 - protein, 372 aa, Panicum virgatum
MRRVALLLLVCAAARAAAVVTDGLLPNGNFEEGPPRSALVNGTVVRGANAIPSWETSGFVEYIESGHKQGDMLLVVPQGAHAVRLGNEASIRQRLAVARGAYYAITFSAARTCAQAERLNVSVSPEWGVLPMQTIYGSNGWDSYAWAFKAKLDAVTLVIHNPGVEEDPACGPLIDGVAIRALYPPRLARGNMLKNGGFEEGPYFLPGASWGVLVPPNIEDDHSPLPAWMIASSKAVKYVDAAHFKVPQGARAVELVGGRESALVQEVRTVPGWSYRLAFAVGDAGDGCAGPMVAEAFAARATVKVPYESKGAGGYKRAVLDFTAIANRTRVVFQSTFYHMKADGTLCGPLVDDASLVGLRKKPAAAGRRLLL

SEQ ID NO: 6780 - protein, 371 aa, Setaria italica
MRRVALLLLVCAAARAAAVVTDGLLPNGNFEEGPPKSALVNGTVVRGANAIPLWETSGFVEYIESGHKQGDMLLVVPQGAHAVRLGNEASIRQRLAVTRGAYYAITFSAARTCAQAERLNVSVSPEWGVLPMQTIYGSNGWDSYAWAFKAKFDTVTLVIHNPGVEEDPACGPLIDGVAIRALYPPTLVRGNMLKNGGFEEGPYFLPNASWGVLVPPNIEDDHSPLPAWMIVSSKAVKYVDAAHFKVPQGARAVELVGGRESALVQEVRTVPGWSYRLSFAVGDAGDGCTGSMVAEAFAARATVKVPYESKGTGGYKRAVLDFTAIANRTRVVFQSTFYHMKADGTLCGPLVDDASLVGLRKKPAAGRRLLL

SEQ ID NO: 6781 - protein, 373 aa, Oryza sativa
MRRVTVLVLLLACAAARAAAAVVTDGLLPNGNFEEGPPKSDLVNGTVVRGANAIPRWETSGFVEYIESGHKQGDMLLVVPQGAHAVRLGNEASIRQRLAVTRGAYYAVTFSAARTCAQAEQLNVSVSPEWGVLPMQTIYGSNGWDSYAWAFKAKMDEVALVIHNPGVEEDPACGPLIDGVAIRALYPPTLAKGNMLKNGGFEEGPYFLPNASWGVLVPPNIEDDHSPLPAWMIMSSKAVKYVDAAHFAVPQGARAVELVGGKESALVQEVRTVPGWTYRLSFAVGDARDGCAGSMVAEAYAARASIKVPYESKGTGGYKRAVLEFAAIANRTRVVFQSTFYHTMTDGSLCGPVIDDASLVGLRKKTAGRRLLL

SEQ ID NO: 6782 - protein, 352 aa, Setaria italica
DDAGLLPNGNFEEGPPKSALVNGTVVRGANAIPLWETSGFVEYIESGHKQGDMLLVVPQGAHAVRLGNEASIRQRLAVTRGAYYAITFSAARTCAQAERLNVSVSPEWGVLPMQTIYGSNGWDSYAWAFKAKFDTVTLVIHNPGVEEDPACGPLIDGVAIRALYPPTLVRGNMLKNGGFEEGPYFLPNASWGVLVPPNIEDDHSPLPAWMIVSSKAVKYVDAAHFKVPQGARAVELVGGRESALVQEVRTVPGWSYRLSFAVGDAGDGCTGSMVAEAFAARATVKVPYESKGTGGYKRAVLDFTAIANRTRVVFQSTFYHMKADGTLCGPLVDDASLVGLRKKPAAGRRLLL

SEQ ID NO: 6783 - protein, 344 aa, Sorghum bicolor
CNNAGLLPNGNFEDGPPKSALVNGTVVSGANAIPRWETSGFVEYIESGHKQGDMLLVVPQGAHAVRLGNEASIRQRLAVARGAYYAITFSAARTCAQAEALNVSVSPEWGVLPMQTIYGSNGWDSYAWAFKAKLSTVTLVIHNPGVEEDPACGPLIDGVAIRALYPPTLARGNMLKNGGFEEGPYFLPNASWGVLVPPNIEDDHSPLPGWMIASSKAVKYVDAAHFAVPQGARAVELVGGRESALVQEVRTVPGWSYRLAFAVGDSGDGCTGSMVAEAYAARATVKVPYESKGTGGYKRAVLDFTAVANRTRVVFQSTFYHMKADGTLCGPLVDDASVVGLRKK

SEQ ID NO: 6784 - protein, 367 aa, Oryza sativa
WINLIKLMVTKKINDVCCAGLLPNGNFEEGPPKSDLVNGTVVRGANAIPRWETSGFVEYIESGHKQGDMLLVVPQGAHAVRLGNEASIRQRLAVTRGAYYAVTFSAARTCAQAEQLNVSVSPEWGVLPMQTIYGSNGWDSYAWAFKAKMDEVALVIHNPGVEEDPACGPLIDGVAIRALYPPTLAKGNMLKNGGFEEGPYFLPNASWGVLVPPNIEDDHSPLPAWMIMSSKAVKYVDAAHFAVPQGARAVELVGGKESALVQEVRTVPGWTYRLSFAVGDARDGCAGSMVAEAYAARASIKVPYESKGTGGYKRAVLEFAAIANRTRVVFQSTFYHTMTDGSLCGPVIDDASLVGLRKKTAGRRLLL

SEQ ID NO: 6785 - protein, 370 aa, Leymus cinereus x Leymus triticoides
MRCAVLLLLVFAAARAAAVVTDGLLPNGNFELGPAKSELVNGTVVKGGKAIPKWETSGFVEYIESGHKQGDMLLVVPQGAYAVRLGNDASILQRIPVARGSYYAITFSAARTCAQAERLNVSVSPESGVLPMQTIYGSNGWDSYAWAFKAKLDVVDLVIHNPGVEEDPACGPLIDAVAIRTLYPPTLSKGNMLKNGGFEEGPYFLPNTSWGVLVPPNIEDDHSPLPAWMIMSSKAVKYVDAAHFKVPEGARAVELVGGKESALVQEVRTVPGWAYRLSFAVGDSGDDCKGSMVAEAYAARATLKVPYDSKGAGGYKRAVLDFVAVRDRTRVVFQSAFYHMKADGTLCGPVIDDAKLVGLRKKPAARRLML

SEQ ID NO: 6786 - protein, 370 aa, Triticum aestivum
MRCAVVLLLVFAAARAAAVVTDGLLPNGNFESGPAKSELVNGTVVKGGKAIPKWETSGFVEYIESGHKQGDMLLVVPQGAYAVRLGNDASILQRIPVARGSYYAITFSAARTCAQAERLNVSVSPESGVLPMQTIYGSNGWDSYAWAFKAKLDVVELVIHNPGVEEDPACGPLIDAVAIRTLYPPTLSKGNMLKNGGFEEGPYFLPNASWGVLVPPNIEDDHSPLPAWMIMSSKAVKYVDAAHFKVPEGARAVELVGGKESALVQEVRTVPGWAYRLSFAVGDSADGCKGSMVAEAYAARSTLKVPYESNGAGGYKRAVLDFVAVRDRTRVVFQSAFYHMKADGTLCGPVIDDAKLVGLRKKPSARRLML

SEQ ID NO: 6787 - protein, 370 aa, Leymus cinereus x Leymus triticoides
MRCAVLLLLVFAAARAAAVVTDGLLPNGNFEAGPAKSELVNGTVVKGGKAIPKWDTSGFVEYIESGHKQGDMLLVVPQGAHAVRLGNDASILQRIPVARGAYYAITFSAARTCAQAERLNVSVSPESGVLPMQTIYGSNGWDSYAWAFKAKLDLVDLVLHNPGVEEDPACGPLIDAVAIRTLYPPTLSKGNMLKNGGFEEGPYFLPNASWGVLVPPNIEDDHSPLPAWMVMSSKAVKYVDAAHFKVPEGARAVELVGGKESALVQEVRTVPGWAYRLSFAVGDSGDDCKGSMVAEAYAARATLKVPYESKGAGGYKRAVLDFVAVRDRTRVVFQSAFYHMKADGTLCGPVIDDAKLVGQRKKPAARRLML

SEQ ID NO: 6788 - protein, 370 aa, Triticum aestivum
MRCAVLLLLVFAAARAAAVVTDGLLPNGNFELGPAKSELVNGTVVKGGKAIPRWETSGFVEYIESGHKQGDMLLVVPQGAYAVRLGNDASILQRIPVARGSYYAITFSAARTCAQAERLNVSVSPESGVLPMQTIYGSNGWDSYAWAFKAKLDVVELVLHNPGVEEDPACGPLVDAVAIRTLYPPTLSKGNMLKNGGFEEGPYFLPNASWGVLVPPNIEDDHSPLPAWMIMSSKAVKYVDAAHFKVPEGARAVELVGGKESALVQEVRTVPGWAYRLSFAVGDSADGCMGSMVAEAYAARSTLKVPYESKGAGGYKRAVLDFVAVRDRTRVVFQSAFYHMKADGTLCGPVIDDAKLVGLRKKPAARRLML

SEQ ID NO: 6789 - protein, 370 aa, Leymus cinereus x Leymus triticoides
MRCAVLLLLVFAAARAAAVVTDGLLPNGNFELGPAKSELVNGTVVKGGKAIPKWDTSGFVEYIESGHKQGDMLLVVPQGAHAVRLGNDASILQRIPVARGAYYAITFSAARTCAQAERLNVSVSPEYGVLPMQTIYGSNGWDSYAWAFKAKLDLVDLVLHNPGVEEDPACGPLIDAVAIRTLYPPTLSKGNMLKNGGFEEGPYFLPNASWGVLVPPNIEDDHSPLPAWMVMSSKAVKYVDAAHFKVPEGARAVELVGGKESALVQEVRTVPGWAYRLSFAVGDSGHDCKGSMVAEAYAARTTLKVPYESKGVGGYKRAVLDFVAVRDRTRVVFQSAFYHMKADGTLCGPVIDDAKLVGLRKKPAARRLML

SEQ ID NO: 6790 - protein, 370 aa, Secale cereale
MRCAVVLLLVFAAARAAAVVTDGLLPNGNFELGPAKSELVNGTVVKGGKAIPKWETSGFVEYIESGHKQGDMLLVVPQGAYAVRLGNDASILQRIPVARGSYYAITFSAARTCAQAERLNVSVSPESGVLPMQTIYGSNGWDSYAWAFKAKLDVVELVLHNPGAEEDPACGPLVDAVAIRTLYPPTLSKGNMLKNGGFEEGPYFLPNASWGVLVPPNIEDDHSPLPAWMIMSSKAVKYVDAAHFKVPEGARAVELVGGKESALVQEVRTVPGWAYRLSFAVGDSADGCKGSMVAEAYAARSTLKVPYESNGAGGYKRAVLDFVAVRDRTRVVFQSAFYHMKADGTLCGPVIDDAKLVGLRKKPAARRLML

SEQ ID NO: 6791 - protein, 370 aa, Secale cereale
MRCAVVLLLVFAAARAAAVVTDGLLPNGNFELGPAKSELVNGTVVKGGKAIPKWETSGFVEYIESGHKQGDMLLVVPQGAYAVRLGNDASILQRIPVARGSYYAITFSAARTCAQAERLNVSVSPESGVLPMQTIYGSNGWDSYAWAFKAKLDVVELVLHNPGAEEDPACGPLVDAVAIRTLYPPTLSKGNMLKNGGFEEGPYFLPNASWGVLVPPNIEDDHSPLPAWMIMSSKAVKYVDAAHFKVPEGARAVELVGGKESALVQEVRTVPGWAYRLSFAVGDSADGCKGSMVAEAYAARSTLKVPYESNGAGGYKRAVLDFVAVRDRTRVVFQSAFYHMKADGTLCGPVIDDAKLVGLRKKPTARRLML

SEQ ID NO: 6792 - protein, 370 aa, Secale cereale
MRCAVVLLLVFAAARATAVVTDGLLPNGNFELGPAKSELVNGTVVKGGKAIPKWETSGFVEYIESGHKQGDMLLVVPQGAYAVRLGNDASILQRIPVARGSYYAITFSAARTCAQAERLNVSVSPESGVLPMQTIYGSNGWDSYAWAFKAKLDVVELVLHNPGAEEDPACGPLVDAVAIRTLYPPTLSKGNMLKNGGFEEGPYFLPNASWGVLVPPNIEDDHSPLPAWMIMSSKAVKYVDAAHFKVPEGARAVELVGGKESALVQEVRTVPGWAYRLSFAVGDSADGCKGSMVAEAYAARSTLKVPYESNGAGGYKRAVLDFVAVRDRTRVVFQSAFYHMKADGTLCGPVIDDAKLVGLRKKPAARRLML

SEQ ID NO: 6793 - protein, 370 aa, Secale cereale
MRCAVLLLLIFAAARAAAVVTDGLLPNGNFELGPAKSELVNGTVVKGGKAIPKWETSGFVEYIESGHKQGDMLLVVPQGAYAVRLGNDASILQRIPVARGSYYAITFSAARTCAQAERLNVSVSPESGVLPMQTIYGSNGWDSYAWAFKAKLDVVELVLHNPGAEEDPACGPLVDAVAIRTLYPPTLSKGNMLKNGGFEEGPYFLPNASWGVLVPPNIEDDHSPLPAWMIMSSKAVKYVDAAHFKVPEGARAVELVGGKESALVQEVRTVPGWAYRLSFAVGDSADGCKGSMVAEAYAARSTLKVPYESNGAGGYKRAVLDFVAVRDRTRVVFQSAFYHMKADGTLCGPVIDDAKLVGLRKKPTARRLML

SEQ ID NO: 6794 - protein, 370 aa, Brachypodium distachyon
MRFAVLLLLVCTAARAAAVVTDGLLPNGNFEAGPPKTDLVNGTVVKGGNAIPNWETSGFVEYIESGHKQGDMLLVVPQGAHAVRLGNEASIRQKLAVARGSYYAITFSAARTCAQAERINISVSPESGVLPMQTIYGSNGWDSYAWAFKAKLDVVQLVLHNVGIEEDPACGPLVDAVAIRTLYPPTLSKGNMLKNGGFEEGPYFLPNASWGVLVPPNIEDDHSPLPAWMIMSSKAVKYVDSAHFRVPEGTRAVELVGGKESALVQEVRTVPGWTYRLTFAVGDAADGCTGSMVAEAYAARAIVKVPYDSKGAGGFKRAVLDFAAVGNRTRIVFQSTFYHMKADGTLCGPVIDDAKLVGLKKKPAARRLML

SEQ ID NO: 6795 - protein, 370 aa, Secale cereale
MRCAVVLLLVFAAARATAVVTDGLLPNGNFELGPAKSELVNGTVVKGGKAIPKWETSGFVEYIESGHKQGDMLLVVPQGAYAVRLGNDASILQRIPVTRGSYYAITFSAARTCAQAERLNVSVSPESGVLPMQTIYGSNGWDSYAWAFKAKLDVVELVLHNPGAEEDPACGPLVDAVAIRTLYPPTLSKGNMLKNGGFEEGPYFLPNASWGVLVPPNIEDDHSPLPAWMIMSSKAVKYVDAAHFKVPEGARAVELVGGKESALVQEVRTVPGWAYRLSFAVGDSADGCKGSMVAEAYAARSTLKVPYESNGAGGYKRAVLDFVAVRDRTRVVFQSAFYHMKADGTLCGPVIDDAKLVGLRKKPAARRLML

SEQ ID NO: 6796 - protein, 370 aa, Secale cereale
MRCAVLLLLIFAAARAAAVVTDGLLPNGNFELGPAKSELVNGTVVKGGKAIPKWETSGFVEYIESGHKQGDMLLVVPQGAYAVRLGNDASILQRIPVARGSYYAITFSAARTCAQAERLNVSVSPESGVLPMQTIYGSNGWDSYAWAFKAKLDVVELVLHNPGAEEDPACGPLVDAVAIRTLYPPTLSKGNMLKNGGFEEGPYFLPNASWGVLVPPNIEDDHSPLPAWMIMSSKAVKYVDAAHFKVPEGARAVELVGGKESALVQEVRTVPGWAYRLSFAVGDSADGCKGSMVAEAYAARSTLKVPYESNGVGGYKPAVLDFVAVRDRTRVVFQSAFYHMKADGTLCGPVIDDAKLVGLRKKPTARRLML

SEQ ID NO: 6797 - protein, 371 aa, Secale cereale
MRCAVLLLLIFAAARAAAVVTDGLLPNGNFELGPAKSELVNGTVVKGGKAIPKWETSGFVEYIESGHKQGDMLLVVPQGAYAVRLGNDASILQRIPVARGSYYAITFSAARTCAQAERLNVSVSPESGVLPCRPSTAATAGTPTPGPFQGQARRRWSSSSTTPAPTEDPAMRPARRRRRHPHALPAHALQGQHAQERRLRGGPLLLPNASWGVLVPPNIEDDHSPLPAWMIMSSKAVKYVDAAHFKVPEGARAVELVGGKESALVQEVRTVPGWAYRLSFAVGDSADGCKGSMVAEAYAARSTLKVPYESNGAGGYKRAVLDFVAVRDRTRVVFQSAFYHMKADGTLCGPVIDDAKLVGLRKKPAARRLML

SEQ ID NO: 6798 - protein, 371 aa, Hordeum vulgare
MRCAVLPLLLVFVAARAAAVVTDGLLPNGNFELGPAKSELVNGTVVKGGKAIPKWETSGFVEYIESGHKQGDMLLVVPQGAYAVRLGNDASILQRIPVARGSYYAVTFSAARTCAQAERLNVSVSPESGVLPMQTIYGSNGWDSYAWAFKAKLDVVELVIHNPGVEEDPACGPLIDAVAIRTLYPPTLSKGNMLKNGGFEEGPYFLPNASWGVLIPPNIEDDHSPLPAWMIMSSKAVKYVDAAHFSVPEGARAVELVGGKESALVQEVRTVPGWAYRLSFAVGDSGHDCKGSMVAEAYAARSTLKVPYESKGAGGYKRAVLDFVAVRDRTRVVFQSAFYHMKADGTLCGPVIDDAKLVGLRKKPAARRLML

SEQ ID NO: 6799 - protein, 393 aa, Sorghum bicolor
MSAAPAAAAAAPPRRVVICGGGVVGACTAYFLSTHAGSPTVPTLIEKCAPACAASGKAGGFLALDWCDSTQALSSLARASFALHRRLADALGGADAYGFRPVHTLSVLLPTHPGPAPASSPHPRLPPWVDPSASAAPPRELGTPDTTAQVHPGLFTKAVLAASGAEVVIGEVERVVARDGRVAGVVVKGRDAVVDADAVVLALGPWSGRLEVVREVFDVSGLKAHSIVLRPREPDKITPHCVFLSYQPEPGAKMLNPEVYPRPTGEVYICGMSKDENPPDDPATITGEPDSIAMLHKIAGKVSSQLKKEEGAEVVVEQACYLPCTTDGLPVIGEMPGVKGCYVATGHSCWGILNGPATGAALAELILDGKAKIVDLEPFSPARFLKRRSRRGA

SEQ ID NO: 6800 - protein, 527 aa, Setaria italica
MDPPWSFVSFFSSAKGRKSFPSLSEFASCAADFVSGAGAVPRRGVKDDGRCALEGRRFVTSQSLSPWIPQWWLSFSGLGSSSSSPSSRGATSTLGALQRILRSKKPPCTNQTPAPTPQSTSASGIPTPPMSAAPAAAAAAAPPRRVIICGGGVVGACTAYFLSTHPASPTVPTVPTLIERCAPACAASGKAGGFLALDWCDSTPALSALARASFALHRRLAADLGGADAYGFRPVHTLSVCVPSVPKPTSPPPHPLLPPWVDPSASAAPPQELGTPDTTAQVHPGLFTRAVLAASGAEVVTGEVERVVVRDGRAAGVVVKGRERDGVVDADAVVLALGPWSGRLEVVSEVFDVSGLKAHSIVLRPPEPEKVTPHCLFLSYQPEPGAKMLDPEVYPRPTGEVYICGMTKDENPPDDPATITGEPDSIAMLHKIAGRVSSQLKKEEGAEVVVEQACYLPCTTDGLPVIGEMPGVKGCYVATGHSCWGILNAPATGAALAELILDGKAKIVDLAPFSPARFLGRRSRCGA

SEQ ID NO: 6801 - protein, 397 aa, Panicum virgatum
ASRLPLSPPPPHAAAAAAAPPRRVVICGGGVVGACTAYFLSTHAASPTVPTLVERCAPACAASGKAGGFLALDWCDSTPGFSALARASYALHRRLAADLGGADAYGYRPVHTLSVRVPSVPKPASPYPMLPAWVDPSASAAPPRELGTPDTTAHVHPGLFTRAVLAASSAKVVIGEVERVVVRDGRAAGVAVKGRDGVVDADAVVLALGPWSGRLEVVSEVFDVSGLKAHSIVLRPREPENITPHCLFLSYQPEPGAKMLDPEVYPRPTGEVYICGMTKDENPPDDPATITGEPNSIAMLHKIAGKVSSQLKKEEGAEVVAEQACYLPCTTDGMPVIGEMPGVKGCYVATGHSCWGILNGPATGAALAELILDGKAKIVDLAPFSPARFLKRSRRGA

SEQ ID NO: 6802 - protein, 386 aa, Brachypodium distachyon
MATAPAAAPPRRVVVCGGGVVGACTAYFLSTHAASPTVPTLIEKSSPACAASGKAGGFLALDWSDSTPSLSALARASFALHGRLAAALDGADAYGFRPVHTLSVSLPSHPISPSSPPHPLLPPWVDPSASAAPPRELGTPATTAQVHPGLFTKAVLAASGAEVVIGEVERVVLGPDDRVAGVQVKGRGVVEADAVVLALGPWSGRFEMVREVFDVSGLKAHSIVLRPRDPDKITPHCLFLSYQPEPGAKMLDPEVYPRPTGEVYICGMTKDEDVPDDPATIVGEPDSIAMLHKIAGRVSSQLKTEEGAEVVAEQACYLPCTNDGLPVIGEMPGVKGCYVATGHSCWGILNAPATGAALAELILDGQAKTVDLTLFSPARFLKKRRR

SEQ ID NO: 6803 - protein, 386 aa, Triticum aestivum
MASAPAPPPRRVVVCGGGVVGACTAYFLSTHPASPTVPTLIEKSSPACAASGKAGGFLALDWSDSTPALSALARASFGLHHRLAAALDGANAYGFRPVHTLSICLPSQPAEPLSPHPLLPSWVDPSASAAPPRQLGTPDTTAQVHPGLFTKAVLAASGAEVVIGEVERVVVGEGCVVGVAVKGRGVVDADAVVLALGPWSGRFEMVIEVFDVSGLKAHSIVLRPRNPDKITPHCLFLSYQPEPGAKMLDPEVYPRPTGEVYICGMSKDEDVPDDPAAIDGEPDSIAMLHKIAGRVSSQLKTEEGAEVVAEQACYLPCTNDGLPVIGEMPGVKGCYVATGHSCWGILNAPATGAALAELILDGQAKIVDLVPFSPARFLKKKSRRGV

SEQ ID NO: 6804 - protein, 386 aa, Secale cereale
MASAPAPPPRRVVVCGGGVVGACTAYFLSTHPASPTVPTLVEKYSPACAASGKAGGFLALDWSDSTPALSALARASFGLHRRLAAALDGANAYGFRPVHTLSICLPSQPAEPLSPHPLLPSWVDPSASAAPPRQLGTPDTTAQVHPGLFTKAVLAASGAEVVVGEVERVVVREGRVVGVAVKGRGVVNADAVVLALGPWSGRFEMVKEVFDVSGLKAHSIVLRPRDPDKITPHCLFLSYQPEPGAKMLDPEVYPRPTGEVYICGISKDEEVPDDPAAIAGEPDSIAMLHKIAGRVSSQLKTEEGAEVVAEQACYLPCTNDGLPVIGEMPGVKGCYVATGHSCWGILNAPATGAALAELILDGQTKIVDLAPFSPARFLKKKSRRGV

SEQ ID NO: 6805 - protein, 391 aa, Oryza sativa
MATSPAAAPPRRVVICGGGVVGACTAYFLSTHAASPTVPTLVEKSSPACAASGKAGGFLALDWCDKTPALSALARASFALHRRLAATLDGGSAYGFRPVHTLSICLPTDPDPAAAAAAAASPLLPAWVDPAASAAPPRELGTTDTTAQVHPGFFTKAVLAASGAEVVIGEAERVVVRDGRVAGVVVRGRGEVDADAVVLALVPWSGRFEMVREVFDVSGLKAHSIVLRPREPENITPHALFLSYQPEPGAKMLDPEVYPRPTGEVYICGMTKDEEVPDDPETITGEPDSIAMLHKIAGRVSGQLKREEGAEVVAEQACYLPCTDDGLPVIGEMPGVKGCYVATGHSCWGILNAPATGAALAELILDGDAKIVDLAPFSPARFLKKKSKRGV

SEQ ID NO: 6806 - protein, 390 aa, Hordeum vulgare
MASAPPAAPPRRVVVCGGGVVGACTAYFLSTHPAFPTVPTLVEKSSPACAASGKAGGFLALDWSDSNPALSALARASFGLHHRLAAALDGANAYGFRPVHTLSICLPSQPEEPLSPHPLLPSWVDPSASAAPPRQLGTPDTTAQVHPGLFTKAVLAASGAEVVIGEVERVVVRQGEGRVVGVAVKGRGVVDADAVVLALGPWSGRFEMVKEVLDVSGLKAHSIVLRPRNPDKITPHCLFLSYQPEPGAKMLDPEVYPRPTGEVYICGMSKDEQVPDDPATIAGEPDSIAMLHKIAGRVSSQLKTEEGAEVVAEQACYLPCTDDGLPVIGEMPGVKGCYVATGHSCWGILNAPVTGAALAELILDGQAKIVDLAPFSPARFLNNKKSRRGV

SEQ ID NO: 6807 - protein, 149 aa, Leymus cinereus x Leymus triticoides
MVVLRPRNPDKITPHCLFLSYQPEPGAKMLDPEVYPRPTGEVYICGMSKEEDVPDDPAAIAGEPDSIAMLHKIAGRVSSQLKREEGAEVVAEQACYLPCTNDGLPVIWEMPGVKGCLRCNRAQLLGHPQCSSYRCSTRRAHPRWTGQDC

SEQ ID NO: 6808 - protein, 450 aa, Setaria italica
MPSRRPSPVLLLLLALALALLFVILSPSSPSASRLSRSLASGSASASSSPATPAAPPPPVKIYMYDLPPKFTYGVVRSYMAARAPSGSADAAAVLPDEQLRYPGHQHSAEWWLFKDLLRRGPRDRPVARVDEPSNADLFYVPFFSSLSLVVNPIRPPAAANASGVAAAYSDEAMQEELLAWLELQPYWQQHRGRDHIFICQDPNALYKVIDRISNAVLLVSDFGRLRSDQASLVKDVILPYSHRINSFKGDVGVDGRPSLLFFMGNRYRKEGGKVRDALFQILEKEEDVTIKHGAQSRESRRAATRGMHSSKFCLHPAGDTPSACRLFDALVSLCIPVIVSDHIELPFEDVIDYSNIAIFVETSKAVQPGYLTSMLRRVSSERILEYQREIKKVKQFFEYEDPNGPVNEIWRQVSLKAPLIKLLTNRNKRLFERGTNGTDCSCMCSTTPY

SEQ ID NO: 6809 - protein, 456 aa, Sorghum bicolor
MPSRRSSPVLLLLLALSLALLFLLLSPSSPSASRFSHSLSSGSVIAYSSPASTSAPPAPVKIYLYDLPAKFTYGVVRSYTATRAPSGSADAAAALPDEQLRYPGHQHSAEWWLFKDLLRRGPRDRPVARVDDPSDADLFYVPFFSSLSLVVNPIRSPPAANASGAAAAYSDDAMQEELLEWLERQPYWRRHMGRDHVFICQDPNALYRVIDRISNAVLLVSDFGRLRSDQASLVKDVILPYSHRINSFKGEVGVDGRPLLLFFMGNRYRKEGGKVRDALFQILENEDDVTIKHGTQSRESRRAARQGMHSSKFCLHPAGDTPSACRLFDALVSLCVPVIVSDYIELPFEDIIDYNKISIFVGTSKAVQPGYLTSMLRRISSERILEYQRETKKVKRYFEYEDPNGPVNEIWRQVSLKAPLIKLLINRNKRLLERGTNGTDCSCICSTTPTEITAAS

SEQ ID NO: 6810 - protein, 453 aa, Oryza sativa
MPSRRPSPLLLLLLALALAFLFLLLSPSAPSASHLSSSLASAAAAVSTPASSPPAPVKIYMYDLPAKFTYGVVRSYMAARARAGAAGAASAIPDDELRYPGHQHSAEWWLFKDLRRRGPLDRPVARVDDPADADLFYVPFFSSLSLVVNPIRPSAAAANASDAAEPAYSDESTQEELLVWLERQPYWRRHQGRDHVFICQDPNALYRVVDRISNAVLLISDFGRLRSEQASLVKDVILPYAHRINSFQGDVGVESRPSLLFFMGNRYRKEGGKVRDTLFQVLENEADVIIKHGAQSRESRRMATRGMHSSKFCLHPAGDTPSACRLFDALVSLCVPVIVSDYIELPFEDVIDYRNISIFVETSKAVQPGFLTSTLRGISSQRILEYQREIKKVKHYFEYEDPNGPVNQIWHQVSSKAPLIKLLINRDKRLVERGTNGTDCSCICSTTKELLRK

SEQ ID NO: 6811 - protein, 453 aa, Brachypodium distachyon
MPSRRPSPALLLLLALALALLFLLLSPSGPSASRLSHSFASASSSYPASSPLPSPVKIYLYDLPSKFTYGVVRSYMSARAPPGSADAAATLPDEELRYPGHQHSAEWWLFKDLRRRGPRERPVARVDDPAEADLFYVPFFSSLSLVVNPIRPLAAANASVAAAEPAYSDEAMQDELVEWLERQPYWRRHRGRDHVFICQDPNALYRVVDRISNAVLLVSDFGRLRGDQASLVKDVILPYSHRINPFQGDVSIEARPALLFFMGNRYRKEGGKVRDTLFQVLENEGDVIIKHGTQSRVSRRMATQGMHSSKFCLHPAGDTPSACRLFDALVSLCVPVIISDHIELPFEDVIDYSNISIFVDTSKAVQPGFLTSMLRRVSSERILEYQREIKRVKHYFEYEDPNGPVNQIWHQVSMKAPLIKLLINRDKRLVERATNETDCSCICSTPSEISTGN

SEQ ID NO: 6812 - protein, 392 aa, Sorghum bicolor
MAGSMQAADAAGRLSALLSLLALRRLLAVLQPLALLLLLPFRWRPRPGAVPTAVASDAAPSASSGASGKKGKASSSVVLRVPAGSPMVAARRQASARREIAMRRAREAGREYELIPTARGETLFTQCWWPHPPSSTVKPRALVVVMHGLNEHSGRYDHLARRLNDIGIKVYGMDWTGHGGSDGLHGYVQSLDYAVNDLKMYLKKVLAENPGLPCFCFGHSTGGGIILKAALDPEVKTLISGIVLTSPAVRVQPAHPVIAVMAPIFALIAPRYQFTASHRNGPPVSRDPEALRAKYTDQLVFTGAIRVRTGYEILRLTSYLQQHLHRIDVPLLVMHGADDLVTDPKGSRALYEQASSADKSLKLYDGLLHDLLIEPEKDKVMDDIVAWLSPKV

SEQ ID NO: 6813 - protein, 394 aa, Pennisetum glaucum
MAGSMQAAEAAGRLSALLSLLALRRLLAVLQPLALLLLLPFRWRARPGAVVAAVASSDAAQSSASGSSGKTKGKASASVVLRVPAGSPMVAARRQASARREIAIRRAREGGREYDLIPTPRGETLFTQCWWPHPPSSTIKPRALVVVMHGLNEHSGRYDHLARRLNEIGIKVYGMDWTGHGGSDGLHGYVQSLDHAVNDLKMYLKKLSAENPGLPCFCFGHSTGGGIILKAALDPEVETLISGVVLTSPAVRVQPAHPIIRVMAPVFALLAPRYQFTASHRNGPPVSRDPEALRAKYTDPLVFTGAIRVRTGYEILRLTSYLQQHLHRITVPILVLHGADDMVTDPDGSRALYELSSSADKSLKLYSGLLHDLLIEPEKDMIMDDIVAWLSPRV

SEQ ID NO: 6814 - protein, 390 aa, Setaria italica
MAGSMQAAEAAGRLSALLSLLALRRLLAVLQPLALLLLLPFRWRARPGAVAAAVASDAAPSSASGPSGKKGKASVVLRVPAGSPMVAARRQASARREIAIRRAREGGREYDLIPTPRGETLFTQCWWPYPPSSTIKPRALVVVMHGLNEHSGRYDHLARRLNEIGIKVYGMDWTGHGGSDGLHGYVQSLDHAVNDLKMYLKKVSAENPGLPCFCFGHSTGGGIILKAALDPEVETLISGVVLTSPAVRVQPAHPIIRVMAPVFALLAPRYQFTASHRNGPPVSRDPEALRAKYTDQLVFTGAIRVRTGYEILRLTSYLQQHLHRITVPILVLHGADDMVTDPDGSRALYEQSSSADKSLNLYPGLLHDLLIEPEKDKIMDDIVAWLSLRV

SEQ ID NO: 6815 - protein, 389 aa, Zea mays
MAGSMQAADAAGRLSALLSLLALRRLLAVLQPLALLLLLPFRWRSRPGAGAAASAPGASGKKGKSASSSSSSSSVVLRVPAGSPMVAARRQASARREVAMRRAREAGREYELIPTARGETLFTQCWWPRPSSTVKPRALVVVMHGLNEHSGRYDHLARRLNDIGIKVYGMDWTGHGGSDGLHGYVQSLDHAVNDLKMYLKKVSAENPGLPCFCFGHSTGGGIILKAALDPDVETLISGVVLTSPAVRVQPAHPIIAAMAPIFALIAPRYQLTASHRNGPPVSRDPEALRAKYADQLVFTGAIRVRTGYEILRLTSYLQPHLQRVAVPLLVMHGADDLVTDPEGSRALYERASSADKSLRLYHGLLHDLLIEPEKDRVMDDIVAWLSRRV

SEQ ID NO: 6816 - protein, 391 aa, Panicum virgatum
MAGSMQAAEAAGRLSALLSLLALRRLLAVLQPLALLLLLPFRWRARPGAAVAEAASDAAPSASGATVKKGKASASVVLRVPAGSPMVAARRQASARREIAIRRAREGGREYELIPTARGETLFTQCWWPYPPTSTIKPRALVVVMHGLNEHSGRYDHLARRLNEIGIKVYGMDWTGHGGSDGLHGYVQSLDHAVSDLKMYLKKVLAENPGLPCFCFGHSTGGGIILKAALDPEVDILINGIILTSPAVRVQPAHPIVRVMAPLFALIAPRYQFTASHRNGPPVSRDPEALRAKYTDPLVFTGAIRVRTGYEILRLTSFLQQHLHRITVPVLVMHGADDMVTDPEGSRALYERSSSADKSLRLYGGLLHDLLIEPEKEAVIEDIVAWLRPRV

SEQ ID NO: 6817 - protein, 392 aa, Oryza sativa
MAGSMQAAEAAGRISALLSLLALRRLIALLQPLALLLLLPFRWRGARPGAAAAAAAAAADAVAASVASGGKKGKAAVVLRVPAGSPIVAARRQASARREIAARRAREAGREYELIPTHRGETLFTQCWWPHGSSSAIKPRALVVVMHGLNEHSGRYDHLARRLNDIGVKVYGMDWTGHGGSDGLHGYVQSLDHAVSDLKMYLKKILAENPGLPCFCFGHSTGGGIILKAMLDPEVDSCVEGIFLTSPAVRVQPAHPIIKVMAPVFALIAPRYQFTASHRNGPPVSRDPEALKAKYSDQLVFTGSIRVRTGYEILRLTSYLQQHLHRITVPMLVMHGADDMVTDPQGSQKLYEEASSSDKSLNLYNGLLHDLLIEPEKEKIMDNIVDWLSPRI

SEQ ID NO: 6818 - protein, 524 aa, Sorghum bicolor
MDAVASDAVLFLLAVTISLLITTATVWNRRREGHDDGAPSPPSLPLLGHLHLLSKPLHHSLAALAAAHGTGTGSGATATPAPLLSLRLGARRALLVSGHAAAEECFTAHDAALAGRPRLLVGDRLNYGYTTVGWSSHGDHWRALRRFLAVELFTASRLAARAADRRAEVAALVATLLRDAAADAAAVTLRPRLFELVLNVMLRALTGAPPPGHGGGDVRGLQEIIEETFAVTGVMSVGDYYPALRWIDRLRGVDAALIRLQARRDAFVAGLVHDKRQSRTAGGRDAEKKSTIDELLSLQETDPEYYTDTVIKGIVSILLSAGTDTSALTLEWAMAQLLTHPEAMLKARAEIDANVGRSRLVEESDMTNLPYLQCVIKETLRLCPVGPVIPAHEAMEDCSVGGFHVRRGTMILVNAWVIHRDPKLWEAPEVFRPERFLDTAMVTMVTAPLLPFGLGRRRCPGEGMAMRLMGLTLAALVQCFDWDVGESGAVDMTEGAGLSMPMTKPLAAICRPREIVKSVLSAST

SEQ ID NO: 6819 - protein, 181 aa, Saccharum officinarum
MACINMYNPDGAAGFGAGPQAPAALGPRISFSSDFAVEPPPPVQNRAMSLRCQEEDLNFEFSVGSHPMMAADQLFSKGRILPLKDNGGASCFANAARPPTTLRDELRGGGDDERASASASSKGSSSSRWKEMLGLRKALCVGGGGNGPAAKKASSSDKQGVAADIMVTDDDMAASNQHQEL

SEQ ID NO: 6820 - protein, 413 aa, Sorghum bicolor
MARARGGAAWVLLAAAWVLWAAAAAEARSPSGRRVHRHLKRLNKPAVKSIESPDGDIIDCVHISHQPAFDHPLLKNHTIQFRPAYHPEGLYEDAKSSIGSNNAGEKPMLQMWHRNGRCPEGTVPIRRTKKDDLLRASSMRRYGRKRHTAPNPLSVDPNMLSEGGHQHAIAYVEGDKYYGAKATINVWEPKIQQANEFSLSQLWILGGSFGEDLNSIEAGWQVSPDLYGDNNTRLFTYWTSDAYQATGCYNMLCSGFIQINSEIAMGASIFPISNYAGSQYDISILIWKDPKEGNWWMQFGKEYVLGYWPSFLFSYLADSASMIEWGGEVVNSEPDGTHTSTQMGSGHFPEEGFGKASYFKNIQVVDSSNQLSAPKGVGTFTEQSNCYDVQNGNNGDWGTYFYYGGPGKNSNCP

SEQ ID NO: 6821 - protein, 413 aa, Saccharum officinarum
MARARGGAAWVLLAAAWVLWAAAAAEARSTPGRRVHRHLKRLNKPAVKSIESPDGDIIDCVHISHQPAFDHPLLKNHTIQFRPAYHPEGLYDDAKSSIGSNNAGEKPMLQMWHRNGRCPEGTVPIRRTKKDDLLRASSMRRYGRKRHTAPNPLSVDPNMLSEGGHQHAIAYVEGDKYYGAKATINVWEPKIQQVNEFSLSQLWILGGSFGEDLNSIEAGWQVSPDLYGDNNTRLFTYWTSDAYQATGCYNMLCSGFIQINSEIAMGASIFPISNYAGSQYDISILIWKDPKEGNWWMQFGKEYVLGYWPSFLFSYLADSASMIEWGGEVVNSEPDGTHTSTQMGSGHFPEEGFGKASYFKNIQVVDSSNQLSAPKGVGTFTEQSNCYDVQNGNNGDWGTYFYYGGPGKNSNCP

SEQ ID NO: 6822 - protein, 415 aa, Panicum virgatum
MARARGGGLAAWAVAVAAAWVLWAAAAAGARSPAGRAHRHLKRLNKPAVKSIESPDGDIIDCVHISHQPAFDHPLLKNHTIQFRPAYHPEGLYDDAKSSIGSDSAGEKPMLQMWHRNGRCPAGTVPIRRTKKDDLLRASSMRRYGRKRHTVPNPLSVDPNMLSEGGHQHAIAYVQGDKYYGAKATINVWEPKIQQANEFSLSQLWILGGSFGEDLNSIEAGWQVSPDLYGDNNTRLFTYWTSDAYQATGCYNMLCSGFIQINSEIAMGASIFPISNYAGSQYDISILIWKDPKEGNWWMQFGKEYVLGYWPSFLFSYLADSASMIEWGGEVVNSEPDGTHTSTQMGSGHFPEEGFSKASYFKNIQVVDSSNQLSAPKGVGTFTEQSNCYDVQNGNNGDWGTYFYYGGPGKNSNCP

SEQ ID NO: 6823 - protein, 415 aa, Setaria italica
MARARGGGPASWVVAVAAAWVLWMATAAEARSPAGRVHRHLKRLNKPAVKSIESPDGDIIDCVPISHQPAFDHPLLKNHTIQFRPAYHPEGLYDDVKSSIGSNNAREKPMLQMWHRNGRCPEGTVPIRRTKKDDLLRASSMKRYGRKRHTAPNPLSVDPNMLSEGGHQHAIAYVEGDKYYGAKATINVWEPKIQQANEFSLSQLWILGGSFGEDLNSIEAGWQVSPDLYGDNNTRLFTYWTSDAYQATGCYNILCSGFIQINSEIAMGASIFPISNYAGSQYDISILIWKDPKEGNWWMQFGKEYVLGYWPSFLFSYLADSASMIEWGGEVVNSEPDGAHTTTQMGSGHFPEEGFSKASYFKNIQVVDSSNQLSAPKGVGTFTEQSNCYDVQNGNNGDWGTYFYYGGPGKNSNCP

SEQ ID NO: 6824 - protein, 413 aa, Pennisetum glaucum
MAMARGGGSPAAWVVAVWVLWAAAAAEARSPAGRVHRHLKRLNKPAVKSIESPDGDIIDCVHISHQPAFDHPLLKNHTIQFRPAYHPEGLYDDVKSSIGSNNAGDKPMLQMWHRNGRCPAGTVPIRRTKKDDLLRASSMRRYGRKRHTAPNPLSVDPNMLSEGGHQHAIAYVEGDKYYGAKATINVWEPKIQQANEFSLSQLWILGGSFGEDLNSIEAGWQVSPDLYGDNNTRLFTYWTSDAYQATGCYNILCSGFIQINSEIAMGASIFPISNYAGSQYDISILIWKDPKEGNWWMQFGKEYVLGYWPSFLFSYLADSASMIEWGGEVVNSQPGGAHTSTQMGSGHFPEEGFSKASYFKNIQVVDSSNQLSAPKGVGTFTEQSNCYDVQNGNNGDWGTYFYYGGPGKNSNCP

SEQ ID NO: 6825 - protein, 412 aa, Brachypodium distachyon
MAAARGGLARLLAAAAVCVLWAAAAEARSPAARVHRHLKRLNKPAVKSIESPDWDIIDCVHISHQPAFDHPLLKNHTLQLRPAFHPEGLYDDTKSSLASGEAGEKPMLQLWHQNGRCQEGTVPIRRTKKDDLLRASSMRRYGRKQHTTPNPLSVDLSMLNEGGHQHAIAYVEGEKYYGARATINVWEPKIQQPNEFSLSQLWILGGSFGADLNSIEAGWQVSPDLYGDNNTRLFTYWTSDAYQATGCYNILCSGFIQINSEIAMGASIFPISNLAGSQYDISILIWKDPKEGNWWMQFGKEYVLGYWPSFLFSYLADSASMIEWGGEVVNSEPNGAHTSTQMGSGRFPEEGFGKASYFKNIQVVDSTNQLKAPKGVGTFTEQSNCYDVQDGNNGDWGTYFYYGGPGKNSNCP

SEQ ID NO: 6826 - protein, 408 aa, Oryza sativa
MAAAWVLAAAAALALWAAAAEGARSPAARVHRHLKRLNKPAVKSIESPDGDIIDCVHLSHQPAFDHPLLKNHTLQMRPAYHPEGLYDDDKRSVASDNAGEKPMLQLWHQKGRCPEGTVPIRRTKKDDLLRASSLRRYGRKRHTAVNPLSIDPNMLNEGGHQHAIAYVEGDKYYGAKATINVWEPKIQQPNEFSLSQLWILGGSFGEDLNSIEAGWQVSPDLYGDNNTRLFTYWTSDAYQATGCYNILCSGFIQINSEIAMGASIFPISNIAGSQYDISILIWKDPKEGNWWMQFGREYVLGYWPSFLFSYLVDSASMVEWGGEVVNSEPDGTHTSTQMGSGRFPEEGFGKASYFKNIQVVDSSNQLKAPKGVGTYTEQSNCYDVQNGNNGDWGTYFYYGGPGKNSNCP

SEQ ID NO: 6827 - protein, 407 aa, Saccharum officinarum
MDTARGVACLLVAVICLSCAAAAAARSPAARLHRHLKRLNKPAVKSIESPDGDMIDCVHISHQPAFDHPYLKNHTIQMRPNYHPEGLYDESKTSSSSGERPMVQLWHQNGRCPEGTVPIRRTKKDDLLRASSMRRYGRKRHTTPNPMSVNPTMLNEGGHQHAIAYVQGDKYYGAKATINVWEPKIEQPNEFSLSQLWILGGSFGEDLNSIEAGWQVSPDLYGDNNTRLFTYWTSDAYQATGCYNMLCSGFIQVNNQIAMGASIFPTSSYSGSQYDISILIWKDPKEGNWWMQFGKDYVLGYWPSFLFSYLADSASMIEWGGEVVNSQPDGVHTSTQMGSGHFPEEGFSKASYFKNIQVVDSTNNLKSPKGLGTFTEQSNCYDVQNGNNGDWGTYFYYGGPGRSSNCQ

SEQ ID NO: 6828 - protein, 410 aa, Setaria italica
MDTARGVACLLVAVICLSCAAAAAARTPAARMHRHLKRLNKPAVKSIESPDGDIIDCVHISHQPAFDHPYLKNHTVQMRPNYHPEGLYDESKTNVASTSNGERPMVQLWHQNGRCPVGTVPIRRTKKDDLLRASSMRRYGRKRHTTANPMSVNPTMLNEGGHQHAIAYVQGDKYYGAKATINVWEPKIEQPNEFSLSQLWILGGSFGEDLNSIEAGWQVSPDLYGDNNTRLFTYWTSDAYQATGCYNILCSGFVQINSEIAMGASIFPTSSYSGSQYDISILIWKDPKEGNWWMQFGKDYVLGYWPSFLFSYLADSASMIEWGGEVVNSQPDGVHTSTQMGSGHFPEEGFSKSSYFKNIQVVDSTNNLKAPKGLGTFTEQSNCYDVQNGNNGDWGTYFYYGGPGRSSNCQ

SEQ ID NO: 6829 - protein, 407 aa, Sorghum bicolor
MDTSRGVACLLVAVICLSCAAAAAARSPAARLHRHLKRLNKPAVKSIESPDGDMIDCVHISHQPAFDHPYLKNHTIQMRPNYHPEGLFDESKTSSSSGERPMVQLWHQNGMCPEGTVPIRRTKKDDLLRASSMRRYGRKRHTTANPMSVNPTMLNEGGHQHAIAYVQGDKYYGAKATINVWEPKIEQPNEFSLSQLWILGGSFGEDLNSIEAGWQVSPDLYGDNNTRLFTYWTSDAYQATGCYNMLCSGFIQVNNQIAMGASIFPTSSYSGSQYDISILIWKDPKEGNWWMQFGKDYVLGYWPSFLFSYLADSASMIEWGGEVVNSQPDGVHTSTQMGSGHFPEEGFSKASYFKNIQVVDSTNNLKAPKGLGTFTEQSNCYDVQNGNNGDWGTYFYYGGPGRSSNCQ

SEQ ID NO: 6830 - protein, 413 aa, Panicum virgatum
MGTTRGVACLLVAVICLSCAAAAAAAAARSPAARLHRHLKRFNKPAVKSIESPDGDIIDCVPITHQPAFDHPYLKNHTVQMRPNYHPEGLYDESKTNVASTSSGDKPKVQLWHQNGRCPEGTVPIRRTKKDDLLRASSMRRYGRKRHTTANPMSVNPTMLNEGGHQHAIAYVQGDKYYGAKATINVWEPKIEQPNEFSLSQLWILGGSFGEDLNSIEAGWQVSPDLYGDNNTRLFTYWTSDAYQATGCYNMLCSGFVQINSEIAMGASIFPTSSYSGSQYDISILIWKDPKEGNWWMQFGKDYVLGYWPSFLFSYLADSASMIEWGGEVVNSQPDGVHTSTQMGSGHFPEEGFSKASYFKNIQVVDSTNNLKAPKGLGTFTEQSNCYDVQNGNNGDWGTYFYYGGPGRSSNCQ

SEQ ID NO: 6831 - protein, 410 aa, Oryza sativa
MATARGGGGVGWLVVVVAVVCLSCAAAAARSPAGRAHRHLKRLNKPAVKSIESPDGDIIDCVHISHQPAFDHPFLKNHTIQMRPNYHPDGLYDESKSGGGGEKPMVQLWHQGGRCPEDTVPIRRTKRDDLLRASSMRRYGKKRHPAPNPMSVDPNLLNEGGHQHAIAYVQGDKYYGAKATINVWAPKIEQPNEFSLSQLWILGGSFGEDLNSIEAGWQVSPDLYGDNNTRLFTYWTSDAYQATGCYNVLCAGFVQINSEIAMGASIFPISSYSGSQYDISIMIWKDPKEGNWWMQFGKDYVLGYWPSFLFSYLGDSASMIEWGGEVVNSQLDGVHTSTQMGSGHFPEEGFSKSSYFKNIQVVDSTNNLKAPKGVGTFTEQSNCYDVQNGNNADWGTYFYYGGPGRSSNCP

SEQ ID NO: 6832 - protein, 411 aa, Triticum aestivum
MAAARVVACLLAAVMCLSCGAAAAARSPEARMHRHLKRLNKPAVKSIESPDGDIIDCVHISHQPAFDHPFLKNHTIQMRPSYHPEGLYDESKANVASSGDGERPMVQLWHRNGRCAPGTVPVRRTKKDDLMRASSMRRYGRKHKPTVANPMSVDLAMLNEGGHQHAISYVQGEKYYGAKATINVWEPKIEQPNEFSLSQLWILGGSFGEDLNSIEAGWQVSPDLYGDNNTRLFTYWTSDAYQATGCYNILCSGFVQINNEVAMGASIFPISGYSGSQYDISILIWKDPKEGHWWMQFGKEYVLGYWPSFLFSYLADSASMIEWGGEVVNSQAEGVHTSTQMGSGHFPEEGFGKASYFKNIQVVDSTNNLKAPHGMGTFTEQSNCYDVQNGNNADWGSYFYYGGPGRSANCQ

SEQ ID NO: 6833 - protein, 415 aa, Brachypodium distachyon
MATARVRVVARLMVAAAAAAVMCLSCAAAARSPEARMHRHLKRLNKPAVKSIESPDGDIIDCVHISHQPAFDHPFLKNHTIQMRPNYHPEGLFDESKANVASSGDGERPMVQLWHQKGRCPEGTVPVRRTKKDDLLRASSIRRYGRKRHTVANPMSVDLSMLNEGGHQHAISYVQGEKYYGAKATINVWEPKIEQPNEFSLSQLWILGGTFGEDLNSIEAGWQVSPDLYGDNHTRLFTYWTSDAYQATGCYNILCAGFVQINSEVAMGASIFPISGYSGSQYDISILIWKDPKEGHWWMQFGKEYVLGYWPSFLFSYLADSASMIEWGGEVVNSQPGGVHTSTQMGSGHFPEEGFSKSSYFKNIQVVDNTNNLKAPKGVGTFTEQSNCYDVQNGNNGDWGSYFYYGGPGRSASCQ

SEQ ID NO: 6834 - protein, 408 aa, Triticum aestivum
MAAARVVACLLAAVMCLSCGAARSPEARMHRHLKRLNKPAVKSIESPDGDIIDCVHISHQPAFDHPFLKNHTIQMRPSYHPEGLYDESKANVASSGDGERPMVQLWHRNGRCAPGTVPVRRTKKDDLMRATSMRRYGRKHKAKAANPMSVDLAMLNEGGHQHAISYVQGEKYYGAKATINVWEPKIEQPNEFSLSQLWILGGSFGEDLNSIEAGWQVSPDLYGDNNTRLFTYWTSDAYQATGCYNMLCSGFVQINNEVAMGASIFPLSGYSGSQYDISILIWKDPKEGHWWMQFGKEYVLGYWPSFLFSYLADSASMIEWGGEVVNSQAEGVHTSTQMGSGHFPEEGFGKASYFKNIQVVDSTNNLKAPHGMGTFTEQSNCYDVQNGNNADWGSYFYYGGPGRSANCQ

SEQ ID NO: 6835 - protein, 410 aa, Zea mays
MDAARWVVCLLVTVICLSCAAAATAAVRSPAARLHRHLKRLNKPAVKSIESPDGDMIDCVHISHQPAFDHPYLKNHTIQMRPNYHPEGLYEESKASSSGGERPMAQLWHQNGRCPEGTVPIRRTRKDDLLRASSMRRYGRKRRAAANPMSVSPTMLNEGGHQHAIAYVQGDKYYGAKATINVWAPKIEQPNEFSLSQLWILGGSFGEDLNSIEAGWQVSPDLYGDNNTRLFTYWTSDAYQATGCYNMLCSGFIQINNQIAMGASIFPTSSYSGSQYDISILIWKDPKEGNWWMQFGKDYVLGYWPSFLFSYLADSASMVEWGGEVVNSQADGVHTSTQMGSGHFPEEGFGRASYFKGVQVVDSSNNLGAPRGGLGTFTEQSSCYDVQSGSNADWGTYFYYGGPGRSSSCQ

SEQ ID NO: 6836 - protein, 404 aa, Hordeum vulgare
MPAGGGDVPLVRGAVAAARSPEARMHRHLKRLNKPAVKSIESPDGDIIDCVHISHQPAFDHPFLKNHTIQMRPSYHPEGLYDESKANVASSGDGERPMVQLWHRNGRCAPGTVPVRRTKKDDLMRASSMRRYGRKHKPTVANPMSVDLAMLNEGGHQHAISYVQGEKYYGAKATINVWEPKIEQPNEFSLSQLWILGGSFGEDLNSIEAGWQVSPDLYGDNNTRLFTYWTSDAYQATGCYNILCSGFVQINNEVAMGASIFPISGYSGSQYDISILIWKDPKEGHWWMQFGKEYVLGYWPSFLFSYLADSASMIEWGGEVVNSQAEGVHTSTQMGSGHFPEEGFGKSSYFKNIQVVDSTNNLKAPHGLGTFTEQSNCYDVQNGNNGDWGTYFYYGGPGRSANCQ

SEQ ID NO: 6837 - protein, 93 aa, Unknown
  Sequence found in Organisms: Sorghum bicolor, Saccharum officinarum
MGVTKEDVEAAITSALSPSNLVVTDTSGGCGASYEIEVVSEKFEGKRLLERHRMVNTALAPHMAEIHAVSIKKALTPAQAQPQPEPAADKPQA

SEQ ID NO: 6838 - protein, 95 aa, Panicum virgatum
MGVTKEDVEAAITSALSPSHLVVTDTSGGCGASYEIEVVSEKFEGKRLLERHRMVNTALAPHMAEIHAVSIKKALTPAQAQPQPQPEPAADKPQA

SEQ ID NO: 6839 - protein, 93 aa, Setaria italica
MGVTKEDVEAAITSALSPSHLVVTDTSGGCGASYEIEVVSEKFEGKRLLERHRMVNTALAPHMAEIHAVSIKKALTPAQAQPQPEPAADKPQA

SEQ ID NO: 6840 - protein, 93 aa, Pennisetum glaucum
MGVTKEDVEAAITSALSPSHLVVTDTSGGCGASYEIEVVSDKFEGKRLLERHRMVNTALAPHMAEIHAVSIKKALTPAQAQPQPEPAADKPQA

SEQ ID NO: 6841 - protein, 93 aa, Panicum virgatum
MGVTKEDVEAAITSALSPSHLVVTDTSGGCGASYEIEVVSEKFEGKRLLERHRLVNTALAPHMAEIHAVSIKKALTPAQAQPQPEPAADKPQA

SEQ ID NO: 6842 - protein, 94 aa, Oryza sativa
MGVTKEDVEAAITSSLSPSSLVVTDTSGGCGASYEIEVVSEKFEGKRLLERHRMVNTALAPHMAEIHAVSIKKALTPAQAQPQPEPAADKAPQA

SEQ ID NO: 6843 - protein, 104 aa, Oryza sativa
MAAAAAAAAAEEEIAVKEPLDLIRLSLDERIYVKLRSDRELRGKLHAYDQHLNMILGDVEEIVTTVEIDDETYEEIVRTTKRTIPFLFVRGDGVILVSPPLRTA

SEQ ID NO: 6844 - protein, 91 aa, Triticum aestivum
VTKEDVEAAITSALSPSNLVVTDTSGGCGASYEIEVVSEKFEGKRLLERHRMVNTALAPHMAEIHAVSIKKALTPAQAQPQPESAADKPQA

SEQ ID NO: 6845 - protein, 93 aa, Brachypodium distachyon
MGVTKEDVESAIAAALSPSHLVVTDTSGGCGASYEIEVVSEKFEGKRLLERHRLVNTALAPHMAEIHAVSIKKALTPAQAQPQPEPAADKPQA

SEQ ID NO: 6846 - protein, 97 aa, Secale cereale
MGVTKEDVQAAVAAALSPTHLVVTDTSGGCGASYEIEVVSDKFEGKRLLERHRMVNTALAPLMAEIHAVSIKKALTPAQAQPQPQPEPAAAAAKPQA

SEQ ID NO: 6847 - protein, 97 aa, Avena sativa
MGVTKEDVEAAVAAALSPTHLVVTDTSGGCGASYEIEVVSDKFEGKRLLERHRMVNTALAPHMAEIHAVSIKKALTPAQAQPQPQPAAAAADDKAQA

SEQ ID NO: 6848 - protein, 97 aa, Secale cereale
MGVTKEDVEAAVAAALSPTHLVVTDTSGGCGASYEIEVVSDKFEGKRLLERHRMVNTALAPLMAEIHAVSIKKALTPAQAQPQPEPAAAAAADKPQA

SEQ ID NO: 6849 - protein, 96 aa, Secale cereale
MGVTKEDVQAAVAAALSPTHLVVTDTSGGCGASYEIEVVSGKFEGKRLLERHRMVNTALAPLMAEIHAVSIKKALTPAQAQPQPEPAAAAADKPQA

SEQ ID NO: 6850 - protein, 96 aa, Avena sativa
MGVTKEDVEAAVAAALSPTHLVVTDTSGGCGASYEIEVVSDKFEGKRLLERHRMVNTALAPHMAEIHAVSIKKALTPAQAQPQPAGAAAADDKAQA

SEQ ID NO: 6851 - protein, 93 aa, Secale cereale
MGVTKEDVEAAVAAALSPAHLVVTDTSGGCGASYEIEVVSDKFEGKRLLERHRMVNTALAPLMAEIHAVSIKKALTPAQAQPEPAAATDKPQA

SEQ ID NO: 6852 - protein, 97 aa, Triticum aestivum
MGVTKEDVEAAVAAALSPTHLVVTDTSGGCGASYEIEVVSDKFEGKRLLERHRMVNTALAPLMAEIHAVSIKALTPAQAQPKPQPEPAAAADKSQQA

SEQ ID NO: 6853 - protein, 93 aa, Hordeum vulgare
MGVTKEDVEAAVAAALSPTHLVVTDTSGGCGASYEIEVVSGKFEGKRLLERHRMVNTALAPLMAEIHAVSIKALTPEQAQPQPSPPAVTADKA

SEQ ID NO: 6854 - protein, 342 aa, Sorghum bicolor
MGRLLPRHPSPLLLLAAAAAAAICISSSSIAAVRGAPVYRADYLVDGNQLVDMQYHMGPVVSGSPTNLYLIWYGRWEPTAQAVLRDFLASLSAPAPFPAVSDWWARTPRMYADQTGANVTGTFAVAGEHSDAGYSHGASLRRIDVQSVIRSAVYAYPDPLPLDPYSGAYLVLTSPDVKVDEFCRAVCGFHYFTFASVVGVTVPYAWVGNSGTQCPGKCAYPFAAAAEYGGGGGAQAVLRPPNGDAGVDGMVIVLGHELAEMSTNPLVNAWYAGDTPTAPTEIADLCLGVYGDGGGPGGLVGNVSRAPDGSAYNVNGVNGRRFLVQWLWNPVRGACYGPNSSN

SEQ ID NO: 6855 - protein, 348 aa, Setaria italica
MGRLLPHHPSLLLLAAAAAAICISSSNLAAVRCTPVYRPDYLVDGNQLVDMQYHMGPVVSGSPTNLYLIWYGRWEPAAQAVLRDFLASLSASAPFPAVSDWWARTPRMYTDQTGANVTGAFAVAGEHSDAGYSHGASLRRADMQSVIRSAVYAYPDPLPLDPYSGAYLVLTSPDVQVDEFCRAVCGFHYFTFASVVGVTVPYLWVGNSATQCPGKCAYPFAAAEYGAGAGAGGGGGGGGGQAVLRPPNGDAGVDGMVIVLGHELAEMSTNPLVNAWYAGDTPTAPTEIADLCLGVYGDGGGAGGMVGNVSRAPDGSAYNVNGVNGRRFLVQWLWNPVRAACYGPNSSN

SEQ ID NO: 6856 - protein, 327 aa, Oryza sativa
MGRLPLLLLLAAAAVSTAGGAPVYRADYLVDGNQLVDMQYHMGPVVSGSPTNLYLIWYGRWEAAAQAVLRDFLASLSAPAAPSPAVSDWWARAPRLYADQTGANVTGAFAVAGERSDAGYSHGASLRRIDMQSVIRSAVYAYPDPLPLDPYSGVYLVLTSPDVQVEEFCRAVCGFHYFTFASVVGVTVPYAWVGNSATQCPGKCAYPFAAPDYGGGAGGQQVLRPPNGDVGVDGMVIVLGHELAELATNPLVNAWYAGDTPTAPTEIADLCLGVYGDGGGAGGLVGNVSRAADGASYNVNGVNGRRFMVQWLWNPVRGACYGPNSSS

SEQ ID NO: 6857 - protein, 339 aa, Brachypodium distachyon
MERLLPCPPTLLPLLLLVLLLAAAMAAVRSAPVYRADYLVDGNQLVNMQYHMGPVVSGSPTNLYLIWYGRWDPAAQAVLRDFLASLSSPAAPSPSVSDWWARAPRLYADQTGANVTAAFAVAGEHSDSGYSHGTSLRRIDVQSIIRAAVVAYPDPLPLDPYSGAYLVLSSPDVQMEEFCRAMCGFHYFTFASVVGVTVPYAWVGNSGTQCPGRCAYPFAPATDYGGGSGGGGQVLRPPNGDPGVDGMVIVLGHELAELATNPLVNAWYAGDTPTAPTEIADLCLGVYGDGGGAGGFVGNVSRAADGSAYNVNGVNGRRFLVQWLWNPVLGKCYGANASN

SEQ ID NO: 6858 - protein, 110 aa, Brachypodium distachyon
MSLIPRSLPPLAGFFRKLYLFWCGWQAGLYFLVSIGLLTSVLSIYYYLKIIKLLMTRRNQEITPYVRNYRRSPLRSNNSIELSMTVCVIASTIPGISMNPILAIAQDTLF

SEQ ID NO: 6859 - protein, 503 aa, Zea mays
MKAFHLLLFHGSFIFPECILIFGLILLLMIDLTSDQKDRPWFYFISSTSLVISITALLFRWREEPIISFSGNFQTNNFNEIFQFLILLCSTLCIPLSVEYIECTEMAITEFLLFVLTATLGGMFLCGANDLITIFVAPECFSLCSYLLSGYTKRDLRSNEATMKYLLMGGASSSILVHGFSWLYGSSGGEIELQEIVNGLINTQMYNSPGISIALIFITVGLGFKLSPAPFHQWTPDVYEGKEARNPLFDSDSPTPVVAFLSVTSKVAASALATRILDIPFYFSSNEWHLLLEILAILSMILGNLLAITQTSMKRMLAYSSIGQIGYVIIGIIVGDSNDGYASMITYMLFYISMNLGTFACIVLFGLRTGTDNIRDYAGLYTKDPFLALSLALCLLSLGGLPPLAGFFGKLYLFWCGWQAGLYFLVSIGLLTSVLSIYYYLKIIKLLMTGRNQEITPYVRNYRRSPLRSNNSIELSMTVCVIASTIPGISMNPILAIAQDTLF

SEQ ID NO: 6860 - protein, 503 aa, Sorghum bicolor
MKAFHLLLFNGSFIFPECILIFGLILLLMIDLTSDQKDRPWFYFISSTSLVISITALLFRWREEPIISFSGNFQTNNFNEIFQFLILLCSTLCIPLSVEYIECTEMAITEFLLFVLTATLGGMFLCGANDLITIFVAPECFSLCSYLLSGYTKRDLRSNEATMKYLLMGGASSSILVHGFSWLYGSSGGEIELQEIVNGLINTQMYNSPGISIALIFITVGLGFKLSPAPFHQWTPDVYEGKEARNPLFDSDSPTPVVAFLSVTSKVAASALATRILDIPFYFSSNEWHLLLEILAILSMILGNLLAITQTSMKRMLAYSSIGQIGYVIIGIIVGDSNDGYASMITYMLFYISMNLGTFACIVLFGLRTGTDNIRDYAGLYTKDPFLALSLALCLLSLGGLPPLAGFFGKLYLFWCGWQAGLYFLVSIGLLTSVLSIYYYLKIIKLLMTGRNQEITPYVRNYRRSPLRSNNSIELSMTVCVIASTIPGISMNPILAIAQDTLF

SEQ ID NO: 6861 - protein, 503 aa, Zea mays
MKAFHLLLFHGSFIFPECILIFGLILLLMVDLTSDQKDRPWFYFISSTSLVISITALLFRWREEPIISFSGNFQTNNFNEIFQFLILLCSTLCIPLSVEYIECTEMAITEFLLFVLTATLGGMFLCGANDLITIFVAPECFSLCSYLLSGYTKRDLRSNEATMKYLLMGGASSSILVHGFSWLYGSSGGEIELQEIVNGLINTQMYNSPGISIALIFITVGLGFKLSPAPFHQWTPDVYEGKEARNPLFDSDSPTPVVAFLSVTSKVAASALATRILDIPFYFSSNEWHLLLEILAILSMILGNLLAITQTSMKRMLAYSSIGQIGYVIIGIIVGDSNDGYASMITYMLFYISMNLGTFACIVLFGLRTGTDNIRDYAGLYTKDPFLDLSLALCLLSLGGLPPLAGFFGKLYLFWCGWQAGLYFLVSIGLLTSVLSIYYYLKIIKLLMTGRNQEITPYVRNYRRSPLRSNNSIELSMTVCVIASTIPGISMNPILAIAQDTLF

SEQ ID NO: 6862 - protein, 503 aa, Oryza sativa
MKAFHLLLFQGSFIFPECILIFGLILLLMIDLTSDQKDRPWFYFISSTSLVISITALLFRWREEPIISFSGNFQTNNFNEIFQFLILLCSTLCIPLSVEYIECTEMAITEFLLFVLTATLGGMFLCGANDLITIFVAPECFSLCSYLLSGYTKRDLRSNEATMKYLLMGGASSSILVHGFSWLYGSSGGEIELQEIVNGLINTQMYNSPGISIALISITVGLGFKLSPAPFHQWTPDVYEGKEARNPLFDSDSPTPVVAFLSVTSKVAASASATRILDIPFYFSSNEWHLLLEILAILSMILGNLLAITQTSMKRMLAYSSIGQIGYVIIGIIVGDSNDGYASMITYMLFYISMNLGTFACIVLFGLRTGTDNIRDYAGLYTKDPFLALSLALCLLSLGGLPPLAGFFGKLYLFWCGWQAGLYFLVSIGLLTSVLSIYYYLKIVKLLMTGRNQEITPYVRNYRRSPLRSNNSIELSMTVCVIASTIPGISMNPILAIAQDTLF

SEQ ID NO: 6863 - protein, 503 aa, Oryza sativa
MKAFHLLLFQGSFIFPECILIFGLILLLMIDLTSDQKDRPWFYFISSTSLVISITALLFRWREEPIISFSGNFQTNNFNEIFQFLILLCSTLCIPLSVEYIECTEMAITEFLLFVLTATLGGMFLCGANDLITIFVAPECFSLCSYLLSGYTKRDLRSNEATMKYLLMGGASSSILVHGFSWLYGSSGGEIELQEIVNGLINTQMYNSPGISIALISITVGLGFKLSPAPFHQWTPDVYEGKEARNPLFDSDSPTPVVAFLSVTSKVAASASATRILDIPFYFSSNEWHLLLEILAILSMILGNLLAITQTSMKRMLAYSSIGQIGYVIIEIIVGDSNDGYASMITYMLFYISMNLGTFACIVLFGLRTGTDNIRDYAGLYTKDPFLALSLALCLLSLGGLPPLAGFFGKLYLFWCGWQAGLYFLVSIGLLTSVLSIYYYLKIVKLLMTGRNQEITPYVRNYRRSPLRSNNSIELSMTVCVIASTIPGISMNPILAIAQDTLF

SEQ ID NO: 6864 - protein, 111 aa, Populus trichocarpa
MSLIPTLWAYFQFRFFRKLHLFWCGSQAGLYFLVSIGLLTSVLSIYYYLKIIKLLMIGQNQEITPHVRNYRGSPLRSNNSIELSMIVCVIASTIPGISMSPIIEIAQDTLF

SEQ ID NO: 6865 - protein, 462 aa, Ricinus communis
MKAFHLLLFDGSFIFPECILIFGLILLLMIDSISDKKDIPWLYFISSTSLVISIMALLFRWGEEPMISFSGNFQTNNFNEIFQFLILLCSTLCIPLSVKYIECTEMAITEFLLFVLTATLGGMFLCSANDLITIFVAPECFSLCSYLLSGYTKKDVRSNEATMKYLLMGGASSSILVHAFSWLYGSSGGEIELQEIVNGLINTQMYNSPGISIALIFITVGIGFKLSPAPSHQWTPNVYEGKEVRNPLFDSDSPTLVVAFLSITSKVAASASATRIFDIPFYFSSNEWHLLLEILAILSMIVMNLIAITQISMKHMLAYSSIGQIGYVIIGIIIGDSNGGYASMITYMLFYISMNLGTFACIVLFGLSTGTDNIREYAGLYTKDPFLALSLAPMSLIPRRSSSTSKFFRKTPFILVWMAGRPIFLGFNRTPYERCFYLLLSKNNQIINDWTKPRNNPSRAKL

SEQ ID NO: 6866 - protein, 179 aa, Ricinus communis
MAITEFLLFVLTATLGGMFLCGANDLITIFVAPECFSLCSYLLSGYTKKDVRSNEATMKYLLMGGASSSILVHAFSWLYGSSGGEIELQEIANGLINTQMYNSSGLLIALIFITVGIGFKLSPAPSHQWTPDVYEGKEVRNPLFDSDSPTPVFAFLSVTSKVAASASATQIFDIPFYFS

SEQ ID NO: 6867 - protein, 499 aa, Lotus japonicus
MKAFHLLLFDGSFIFPECILIFGLILLLMIDSTSDQKDISWFYFISSTSLVMSIVVLLFRWREEPMISFSGNFQTNNFNEIFQFLILLSSTLCIPLSVEYIECTEMAITEFLLFVLTATLGGMFLCSANDLITIFVAPECFSLCSYLLSGYTKKDVRSNEATMKYLLMGGASSSILVHGFSWLYGSSGGEIELQEIVNGLINTQMYNSPGISIALIFITVGIGFKLSLAPSHQWTPDVYEGNPLFDSDSPTPVVAFLSVTSKVAASALATRIFDIPFYFSSNEWHLLLEILAILSMILGNLIAITQTSMKRMLAYSSIGQIGYVIIGIIVGDSNGGYASMITYMLFYISMNLGTFACIVSFGLRTGTDNIRDYAGLYTKDPFLALSLALCLLSLGGLPPLAGFFGKLYLFWCGWQAGLYFLVSIGLLMSVVSIYYYLKIIKLLMTGRNQEITPHVRNYKRSPLRSNNSIELSMIVCVIASTISGISMNPIIEIAQDTLF

SEQ ID NO: 6868 - protein, 503 aa, Medicago truncatula
MKAFHLLVFDGSFIFPELILIFGLILLLMIDSTSDQKDLSWFYFISSTSLVMSITALLFRWREEPMISFSGNFQTNNFNEIFQFLILLSSTLCIPLSVEYIECTEMAITEFLLFILTATLGGMFLCSANDLITIFVALECFSLCSYLLSGYTKKDVRSNEATMKYLLMGGASSSILVHGFSWLYGLSGGEIELQEIVNGLINTQMYNSPGISIALIFITVGIGFKLSLAPSHQWTPDVYEGKEVRNPLFDSDSPTPVVAFLSVTSKVAASASATRIFDILFYFSSNEWHLLLEILAILSMLLGNLIAITQTSMKRMLAYSSIGQIGYVIIGIIVGDSNDGYASMITYMLFYISMNLGTFACIVLFGLRTGTDNIRDYAGLYTKDPFLALSLALCLLSLGGLPPLAGFFGKLHLFWCGWQAGLYFLVSIGLITSVVSIYYYLKIIKLLMTGRNQEITPHVRNYRRSPVRSNNSIELSMIICVIASTVPGISMNPIIEIAQDTLF

SEQ ID NO: 6869 - protein, 246 aa, Prunus persica
MKAFHLLLFDGSFIFPECILIFGLILLLMIDSTSDQKDIPWLYFISSTSLVMSITALLFRWREEPTISFSGNFQTNNFNEIFQFLILLCSTLCIPLSVEYIECTEIAITEFLLFVLTATLGGMFLCGANDLITIFVAPECFSLCSYLLSGYTKKDVRSNEATTKYLLMGGASSSILVHGFSWLYGSSGGEIELQEIVNGLINTQMYNSPRISNALIFITVGIGFKLSPAPSHQWTPDVYEGVRFVR

SEQ ID NO: 6870 - protein, 511 aa, Brachypodium distachyon
MKALHLLVFHGSFIFPECILIFGLILLLMIDSTSNQKDRPWFYFISSTSLVISIMALLFRSREEPIISFSGNFQTNNFNEIFQFLILLCSTLCIPLSVEYIECTEMAITEFLLFVLTATLGGMFLCGANDLITIFVASEYYSLCSYLLSGYTKRDLRSNEATMKYLLMGGASSSILVHGFSWLYGSSGGEIELQEIVNGLINTQMYNSPGISIALISITVGLGFKLSPAPFHQWTPDVYEGKEARNPLFDSNSPTPVIAFLSVTSKVVASALATRIFDIPFYFSSNEWHLLLEILAILSMILGNLLAITQTSMKRMLAYSSIGQIGYVIIGIIVGDLKRSSPLLGFDLYSNDGYASMITYMLLYISMNLGTFACIVLFGLRTGTDSIRDYAGLYTKDPFLALSLALCLLSLGGLPLLADFFGKLYLFWCGWQAGLYFLVSIGLLTSVLSIFYYLKIIKLLMTGRNQEITPYVRNYRRSPLRSNNSIELSMTVRVIASTISGISMNPILAIA

SEQ ID NO: 6871 - protein, 219 aa, Solanum lycopersicum
MISFSGNFQTNNFNKIFQFLILLCSTLCIPLSVEYIECKEMAITEFLLFLLTTTLGGMSLCGANDLITIFVVPECFNLCSYLLSGYTKKDVRSDEATMKYLLMGGASSSILVHRFSWLYGSSGGEIGLQEIVNGLINTQMYNSPGISIALIFITVRIGFKLSPAPSHQWTPDVYEGKEVRNPLFDSDSPTPVVAFVSVTSKVAASASATRIFDIPFYFS

SEQ ID NO: 6872 - protein, 522 aa, Coffea canephora
MKAFHLLLFDGSLIFPECILIFGLILLLMIDSSSDQKDIPWLYFIPSTSLVMSITALLFRWREEPMISFSGNFQTNNFNEIFQFLILLCSTLCIPLSVEYIECTEMAITEFLLFVLTATLGGMFLCGANDFITIFVAPECFSLCSYLLSGYTKKDVRSNEATMKYLLMGGASSSILVHGFSWLYGSSGGEIELQEIVNGLINTQMYNSPGISIALIFITVGIGFKLSPAPSHQWTPDVYEGVRFVREIPTSLSISEMFGFFKTPWTCRREISPTPVVAFLSVTSKVAASASATRIFDIPFYFSSNGWHLLLEILAILSMILGNLIAITQTSMKRMLAYSSIGQIGYVIIGIIVGDSNDGYASMITYMLFYISMNLGTFACIVLFGLRTGTDNIRDYAGLYTKDPFLALSLALCLLSLGGLPPLAGFFGKLYLFWCGWQAGLYFLVLIGLLTSVVSIYYYLKIIKLLMTGRNQEITPHVRNYRRSPLRSNNSIELSMIVCVIASTIPGISMNPIIAIAQDSLF

SEQ ID NO: 6873 - protein, 187 aa, Ricinus communis
MAITEFLLFVLTATLGGMFLCGANDLITIFVAPECFSLCSYLLSGYTKKDVRSNEATMKYLLMGGASSSILVHAFSWLYGSSGGEIELQEIVNGLINTQMYNSPGISIALIFITVGIGFKLSPAPSHQWTPDVYEGKEVRNPLFDSDSPTPVVAFLFVTSKVAASASATRIFDIPFYFSSNEWYILL

SEQ ID NO: 6874 - protein, 143 aa, Sorghum bicolor
MATLSAISAKAGYCKAPTLSWKGSRVSARNVVSMATTRRGGLVSLRSPRFRVYAAKAETVSKVMDIVKQQLALAADVGLTAESKFADLGADSLDTVEIVMALEEEFKITVEEDNAQSITTIQEAADLIDKLVDQNPAAAAPPA

SEQ ID NO: 6875 - protein, 144 aa, Saccharum officinarum
MATLSAISAKAGYGYCRAPTLSWKGSRVSDRNVVSMATTRRGGLLVSLRSPRFRVYAAKAETVSKVMDIVKQQLALAADVGLTAESKFADLGADSLDTVEIVMALEEEFKITVEEDNAQNITTIQEAADLIDKLVGQNPAAPAA

SEQ ID NO: 6876 - protein, 551 aa, Sorghum bicolor
MASLRLAVTHCPALPLPTPHSHLRRRQLQLHPYPNPLSLSPRISSHLSPIPRRHLPPLFASASASQAETKPPPPPTEASGGAKPLPLLISLAAGLAVRFLVPRPAEVTPEAWQLLSIFLSTIAGLVLGPLPVGAWAFLGLTATVATRTLPFTAAFGAFTNEVIWLIVISFFFARGFVKTGLGDRVATYFVKWLGRSTLGLSYGLAISEAFISPAMPSTTARAGGVFLPIVKSLSLSSGSKPNDPSAKKLGSYLVQSQLQAAANSSALFLTAAAQNLLCLKLAEEIGVNIGNPWITWFKVASVPALLGLLVTPYLIYKIFPPEIKDTPEAPALAAEKLKLMGPVTKNEWVMIATMLLAVSLWIFGEAIGVSSVVAAMIGLSILLLLGVLNWEDCLNEKSAWDTLAWFAILVGLAGQLTNLGIVSWMSNCVAKVLQSFSLSWPAAFGVLQASYFLIHYIFASQTAHVGALYSAFLAMHLAAGVPAVMSALALAYNANLFGALTHYSSGQSAVYFGAGYVDLPDVFKLGFITAALNAVVWGVAGAFWWKFLGLY

SEQ ID NO: 6877 - protein, 554 aa, Setaria italica
MESLRLAVSHRPALPLPIPHGHLRRGHLQLQPSPNSLSLSLPISPHLTLFPTTRRHLPPILASASASAVAKPSPDPKPAAAAGGAKPLPLLISLAAGLAVRFLVPRPAEVTPQAWQLLSIFLSTIAGLVLGPLPVGAWAFLGLTATVATRTLPFTAAFGAFTNEVIWLIVISFFFARGFVKTGLGDRVATYFVKWLGRSTLGLSYGLAISEAFIAPAMPSTTARAGGVFLPIVKSLSLASGSKPNDPSAKKLGSYLVQSQLQASSNSSALFLTAAAQNLLCLKLAEELGVKIANPWVTWLKVASLPAIVGLLVTPYLLYKIFPPEIKDTPDAPALAAQKLKNMGPVTRNEWVMIGTMILAVSLWIFGEAIGVSSVVAAMIGLSILLLLGVLNWEDCLNEKSAWDTLAWFAILVGLAGQLTSVGIVSWMSNCVANVLQSFSLSWPAAFGVLQASYFFIHYLFASQTAHVGALFSAFLAMHLAAGVPGQLAALALTYNANLFGALTHYSSGQAAVYYGAGYVDLPDVFKLGFTTAALNAVIWGVVGAFWWKFLGLY

SEQ ID NO: 6878 - protein, 555 aa, Oryza sativa
MERLRVAISHHRAALPLPTHHNHFRRRHLQLQPFPSSLSLSLPISPQLSPAPPRRHLLPPLLASASAAQAAGPAPARAAGGGGGGAKPVPLLVSLAVGLAVRFLAPRPAEVTPQAWQLLSIFLTTIAGLVLGPLPVGAWAFLGLTATVATRTLPFTAAFGAFTNEVIWLIVISFFFARGFVKTGLGDRVATYFVKWLGRSTLGLSYGLAISEACIAPAMPSTTARAGGVFLPIVKSLSLSAGSKPNDPSARKLGSYLVQSQLQASGNSSALFLTAAAQNLLCLKLAEEIGVKIANPWISWFKVASLPAIISLLATPYLLYKIFPPEIKDTPEAPAIAAQKLKNMGPVTRNEWIMVATMILAVSLWIFGDTIGVSSVVAAMIGLSILLLLGVLNWEDCLNEKSAWDTLAWFAILVGMAGQLTNLGIVSWMSNCVAKVLQSFSLSWPAAFGVLQASYFFIHYLFASQTAHVGALYSAFLAMHLAAGVPAILSALALTYNSNLFGALTHYSSGQSAVYYGAGYVDLPDVFKLGFTTAAINAVIWGVVGTFWWKFLGLY

SEQ ID NO: 6879 - protein, 556 aa, Avena sativa
MERLRLAVSHRPALPLPTPHNHLRRRHLQLQLSPNSLSLSRPISPHLSPTPRRHLHPLLASASAAQAASPEPNPAPAPTAAAASAGAKLIPLVVSVAVGLAVRFLAPRPPEVTPQAWQLLSIFLSTIAGLVLGPLPVGAWAFLGLTATVATRTLPFTAAFGAFTNEVIWLIVISFFFARGFVKTGLGDRVATYFVKWLGGSTLGLSYGLTISEACIAPAMPSTTARAGGVFLPIVKSLSLSAGSKPNDPSAKKLGAYLVQSQLQASGNSSALFLTAAAQNLLCLKLAEEAGVKIASPWISWFKVASLPAIISLLATPYLLYKIFPPEIKDTPEAPALAAEKLKKMGPVTKNEWVMVSTMILAVSLWIFGDAIGVSSVVAAMIGLSILLLLGVMNWDDCLNEKSAWDTLAWFAILVGMAGQLTNLGIVSWMSNCVAKVLQSFSLSWPAAFGVLQASYFFIHYLFASQTAHVGALYSAFLAMHLAAGVPAILSALALTYNSNLFGALTHYSSGQSAVYYGAGYVDLPDVFKLGFAAAAINALIWGVVGTFWWKFLGLY

SEQ ID NO: 6880 - protein, 556 aa, Brachypodium distachyon
MERLRLAVSHRPALPLPAPHNHLRRRHLQLQSSPNSLSLSRPISPHLSPTPRRHLHPLLASASATQAASSSPEPTPAPVAAVSSAGAKLIPLIASVAVGLAVRFLAPRPAEVTPEAWQLLSIFLSTIAGLVLGPLPVGAWAFLGLTATVATRTLPFTAAFGAFTNEVIWLIVISFFFARGFVKTGLGDRVATYFVKWLGGSTLGLSYGLTISEACIAPAMPSTTARAGGVFLPIVKSLSLSAGSKPNDPSAKKLGAYLVQSQLQASGNSSALFLTAAAQNLLCLKLAEEAGVKIASPWILWFKVASLPAIIALLATPYLLYKIFPPEIKDTPDAPALAAQKLEKMGPVTKNEWVMVATMVLAVSLWIFGDIIGVSSVVAAMIGLSILLLLGVMNWDDCLNEKSAWDTLAWFAILVGMAGQLTNLGIVSWMSNCVAKVLQSFSLSWPAAFGVLQASYFLIHYLFASQTAHVGALYSAFLAMHLAAGVPALLSALALTYNSNLFGALTHYSSGQSAVYYGAGYVDLPDVFKLGFASAAINAAIWGVVGTFWWKFLGLY

SEQ ID NO: 6881 - protein, 556 aa, Secale cereale
MERLHLAVSHRPALPLPTPHNHLRRRHLQLQPSTNSLSLSRPISRHISLATRRHLHPLLASASATQASSPNTEPAPAPAPAAASAGAKLLPLIASIAVGLAVRFLAPRPPEVTPQAWQLLSIFLSTIAGLVLGPLPVGAWAFLGLTATVATGTLPFTAAFEAFTNEVIWLIVISFFFARGFVKTGLGDRVATYFVKWLGGSTLGLSYGLTISEACIAPAMPSTTARAGGVFLPIVKSLSLSAGSKPNDPSAKKLGAYLVQSQLQASGNSSALFLTAAAQNLLCLKLAEEAGVKIASPWISWFKVASLPAIISLLATPYLLYKIFPPEIKDTPEAPALAAQKLKKMGPVTKNEWVMVATMILAVSLWIFGDAIGVSSVVAAMIGLSILLLLGVMNWDDCLNEKSAWDTLAWFAILVGMAGQLTNLGIVSWMSNCVAKVLQSFSLSWPAAFGVLQASYFFIHYLFASQTAHVGALYSAFLAMHLAAGVPAILSALALTYNSNLFGALTHYSSGQSAVYYGAGYVDLPDVFKLGFTAAAINALIWGVVGTFWWKFLGLY

SEQ ID NO: 6882 - protein, 556 aa, Triticum aestivum
MERLHLAVSHRPALPLPTPHNHLRRRHLQLQPSTSSLSLCRPISPHISLAPRRHLHPLLASASATQASSPNTEPAPAPAPAAASSGAKLLPLIASIAVGLAVRFLAPRPPEVTPQAWQLLSIFLSTIAGLVLGPLPVGAWAFLGLTATVATGTLPFTAAFGAFTNEVIWLIVISFFFARGFVKTGLGDRVATYFVKWLGGSTLGLSYGLTISEACIAPAMPSTTARAGGVFLPIVKSLSLSAGSKPNDPSAKKLGAYLVQSQLQASGNSSALFLTAAAQNLLCLKLAEEAGVKIASPWISWFKVASLPAIISLLATPYLLYKIFPPEIKDTPEAPALAAQKLKKMGPVTKNEWVMVATMILAVSLWIFGDAIGVSSVVAAMIGLSILLLLGVMNWDDCLNEKSAWDTLAWFAILVGMAGQLTDLGIVSWMSNCVAKVLQSFSLSWPAAFGVLQASYFFIHYLFASQTAHVGALYSAFLAMHLAAGVPAILSALALTYNSNLFGALTHYSSGQSAVYYGAGYVDLPDVFKLGFTAAAINALIWGVVGTFWWKFLGLY

SEQ ID NO: 6883 - protein, 497 aa, Sorghum bicolor
DPPGCPASSATPSPKPAPAPAPAASGGAKPLPLFISLALGLAVRFLVPRPAQVTSQAWQLLSIFLSTIAGLVLAPLPVGAWAFLGLTVTVATRTLSFAAAFGAFTNEVIWLIVISFFFARGFVKTGLGDRVATYFVKWLGRSTLGLSYGLVISEAVISPAMPSTTARAGGVFLPIIKSLSLSSGSKPNDPSAKKLGSYLVQSQLQAAANSSALFLTAAAQNLLCLKLAEEIGVNIGNYWFTWFKVASVPALLGILVTPYLIYKIFPPEIKDTPEAPALAAEKLKNMGPVTKNEWAMIATMLLAVSLWIFGQTIGVSSVVASMIGLSILLLLGVLNWEDCLNEKSAWDTLAWFAILVGLAGQLTKLGIVSWISSSVAKILRSFSLSWPAAFGVLQASFFFIHYIFASQTAHVGALYSAFLAMHLAADVPAVMSTLALAYNANLFGSLTHYSSGQSAVYFGAGYVGLGDVFKLGFITAVINAVIWGAAGALWWKLLGLY

SEQ ID NO: 6884 - protein, 325 aa, Zea mays
MSNRATHWCYACRRPIRLRGQDIACPNCNDGFIQEISEMGGILNTYGLIEPDFEERRARRFGMMDAMSSLMRQRMEEMGRDGLFDIRGRQGTGTEYGRRPTAVPTLVFGGIPSPGVDSGDVNVVLRGGRRVGAAQPNFSSLVVGPSLEALFEQLLLQNNRQGPAPAPQSAIDSMPVVKINRRHLDDDPQCAVCKDKFEVGAEAREMPCKHLYHTDCIIPWLVQHNSCPVCRHPLPSQRSGSTSSARPSAYYNEAADPPGVTRADLEPAPRDGGRESQERRRSFSFLWPFGPSSSRSSSYQYEQNVDEPAVYDPNQIAYSEWHYDH

SEQ ID NO: 6885 - protein, 326 aa, Saccharum officinarum
MSNRATHWCYACRRPVRLRGQDIICPNCNDGFIQEISEMGGRLNTYGLIEPEFEERRARRFGMMDAMSSLMRQRMEEMVEDSLFDVHGRQGTGTEYGRRPTAVPTLVFGGIPSPGVGSSDVNVVLRGGRRVGAVHPNFSSLVVGPSLEALFEQLLLQNNRQGPAPAPQSAIDSMPVVKINRRLLDDDAQCAVCKDEFEVGAEAREMPCKHLYHTDCIIPWLVQHNSCPVCRHPLPSQRSGSTSTPRVPSAYYNEAADPPGVTRADLEPAPRNSGSESQERHSSFSFLWPFGPSNSSPSAYQYEENVDEPAVYDPNQIAYSEWHYDH

SEQ ID NO: 6886 - protein, 241 aa, Sorghum bicolor
MSPQQQQRVAIVGEEYCEGEDRELTVRKTTLFTPGDGLEAYDHRNGALAFRVETYGRGGACGGGAARGDLALLGARGEPVLTVRRRRPSLHNRWDGFLGDGAAQGQKPVFSARRSSILGAGTGAAAVLVDLLAPVAGEFRVDGSFPRRCCRVVASAKAWAAGDGKGEEEEAEEDVVVAEVRRKVDEDAHVMMGRDVFVLWVRAGFDAAFAMGIVLVLDRITEDDVDGDLGEELLEAATSPA

SEQ ID NO: 6887 - protein, 231 aa, Oryza sativa
MVIVGEEHCGGGEDRELTVRKTTLFCPGDGLEAYDHGTGTLAFRVETYGRGGVCGGGAAAGDLALLGPEGEPVLTVRRRRPSLHHRWDGFLGDGAASGQKPLFSARRSSILGVGSGAAAVLVDLLAPGAAGEFRVDGSFPRRCCRVVAVKAAAPAGGGGEEEEEEVVVAEVRRKVDEDAHVVMGRDVFVLWLRAGFDAAFAMGIVLVLDRITGDELNGDLSEDLAVASSPV

SEQ ID NO: 6888 - protein, 135 aa, Setaria italica
MASRCFFPRDAAADARHQSKAAAAALEQLNHGGRLLSREDVGGAVRVKIVVSKRELKQMVAALGDGAGAVTAAATAAAATSERHRQRAAGAGPGAEQRLQSLRRRSMRRAAEAARRMQANGEWEPGLQSIPEEVY

SEQ ID NO: 6889 - protein, 131 aa, Zea mays
MASRCFFPRDAAAADHPQSKAAAAQALERLHHGGRLLSREDVGGAVRVKIVVSKRELKQMVAALGDGGLVAAASSERHRQRAAAAAGPGAEQRLQSLRRRSVRRAAEAAARRMQAGGEWEPGLQSIPEEVC

SEQ ID NO: 6890 - protein, 212 aa, Sorghum bicolor
MAPAASSTSASPLSRLLLLLSLPKPGAARHPTSSSSSPARPCPDAGLVLRRREAAAAVLSTALLSRFVLPAAASAAADGGGECPLEVAPSGLAFCDRVVGTGAAAQEGQLIRAHYTGRLEDGTVFDSSYKRGRPLTFRVGVGEVIKGWDQGIVGGEGIPPMLAGGKRTLKLPPALAYGEKGAGCRGWEPTSCVIPPNSTLLFDVEYVGRASG

SEQ ID NO: 6891 - protein, 211 aa, Setaria italica
MAPSTSTTSPLSRLLLSLPKPGAARHPRPAPCPDAACSAKSPGAGLVLRRREAAAAVLSAAVLSRFLLLPAAAEAADSGGECPLEVAPSGLAFCDRVVGTGAAAQEGQLIRAHYTGKLEDGTVFDSSYKRGKPLTFRVGVGEVIKGWDQGIVGGEGIPPMLAGGKRTLKLPPALAYGEKGAGCRGWEPTSCVIPPNSTLLFDVEYVGTAFG

SEQ ID NO: 6892 - protein, 449 aa, Sorghum bicolor
MAPAASSTSASPLSRLLLLLSLPKPGAARHPTSSSSSPARPCPDAGLVLRRREAAAAVLSTALLSRFVLPAAASAAADGGGECPLEVAPSGLAFCDRVVGTGAAAQEGQLIRAHYTGRLEDGTVFDSSYKRGRPLTFRVGVGEVIKGWDQGIVGGEGIPPMLAGGKRTLKLPPALAYGEKGAGCRGWEPTSCVIPPNSTLLFDVETQDMLKSKLILEDEFAWSLPSVGSGSDEHERCKLKYIGGTDISFLKEDPATACAAVVVLNADTLEVVHEEFNVVRLQVPYIPGFLAFREAPVLLGLLEKVKINAPHFYPQLLMVDGNGLLHPRGFGLACHLGVLADVPTIGVGKNLHHVDGLNQSEVRRLLESKENCNKELILLTGQSGTKWGTAMRSCPGSLKPIYISVGHRISLDSAMVIVKSCCKYRVPEPTRQADIRSKAFLQKLQKPRQ

SEQ ID NO: 6893 - protein, 214 aa, Panicum virgatum
  misc_feature (91)..(91): Xaa can be any naturally occurring amino acid
MGAPSTSTSPLSRLLLSLPKPGAARHPRASPAAPCPDVSKSAGAGAGLVLIRRREAVAAVLSGAALSRSLPLLPASAEAADGGECPLEVAXSGLAFCDRVVGTGAAAQQGQLIQAHYTGRLEDGTVFDSSYKRGRPLIFRVGVGEVIKGWDQGIVGGEGIPPMLAGGKRTLKLPPALAYGEKGAGCRGWEPTSCVIPPNSTLLFDVEYVGRAVS

SEQ ID NO: 6894 - protein, 419 aa, Sorghum bicolor
MKLLGWMHRKLRQNSNDVFKEFNNGGGGTCNCLTGLASPDPATFLASANEYFAGDHDFTNIHSSPPDTDLFTFGGSGLLTIGTLGITAVAVPADADDDDYDVDVDADSDSDDNDDTADEGDKVDSAVTPTFTYTAPPTALAEAAEVVEKAAVAVVEAIAEKDDDTTTEDDLMVVSAELEKVLGGRNSGAAGDLIASARVSFAMGVDCPLQGFLFGSPVSDAAESRLEQPRDSNGGRRTSLGELFMRTRFADEKVALVAVEEGEDGGDGGAAGGERDDGKAGKGGGCHKTTKKRRVKDDKVAGGDGTPASAAVTKSKFQKILQIFHRKVYPESAALARNLTKKSRKRGSGGADEPAEPASSNKLRCRKEQRAPGFGCCANRASFGGAASPIHDDDDDDELNGSKSGHWIKTDAEYLVLEL

SEQ ID NO: 6895 - protein, 411 aa, Setaria italica
MKLLGWMHRKLRQNSNDVFKEFNNGGGGTCNCITGLASPDPATFLASANEYFAGDGFTTNNQSPPDTDLFTFGGSGLLTIGTLGIAAVAIPSDAEDEDYDVDDVDAESDSDDNDNTVDEEDDVDIDGAVTPTFTYPQPPPVETAAVEEKAVAAVEAIAEKNDDTTTEDDLMVVSAELEKVLGGRNSGAAGDLVASARVSFAMGVDCPLQGFLFGSPVSDAESRLEQPRDSNGGRRTSLGELFMRTRFADEKVALVAVEEGEDGAAGGETEDGKEGKGGDGRKTVKKRRVNDGKGAGGEGAPASAAVTKSKFQKILQIFHRKVYPESTALARSLTKKSRKRGSSSASADEPELALPKLRCRKEQRAPGFGCCANRASFGGAATPIDDDDDELNGSKSGHWIKTDAEYLVLEL

SEQ ID NO: 6896 - protein, 180 aa, Saccharum officinarum
MASIPHPPPVIGKSGNLTVFVTPPAEPESPRSEFSTPPTSPRAEDSPESPPAQAAPPPAPVYSVSTPPLVKTVSPPLPAEKLSRPSLLQAPKLSSRSLPPVQVPPLQFAKASEGSDGSLLAFFWDAVARVQEAHASLDEHISRWFGLDQSKYQWALNDYYERTGQEIDLSHAGTRKEDTL

SEQ ID NO: 6897 - protein, 436 aa, Sorghum bicolor
MESLVLASSCSASPRLPLISSAARFRRLPGSVPPPTVAAASTGGAARKGPRRPRLFVVAAAAPRGSGNVFEGLRAKGFASVSSSTGNENMSTGTGTLPPVPPPSSYFGSPVFWIGVGVALSVAFTTVSSMVKRYAMEQAFKSMMTQAPPNSFGSNSPFPFGMPPQASPTAPSSFPYLEPKKDTSPQVSTVDVSATEVEAAGTSKEVDVTETPEPSKKFAFVDVSPEELQQKNLQSSLETVDVKHDSTDSESKEDIEEKVLPTNGATFKPNEDAARGPTEPSNSGPMLSVETIEKMMEDPTVQKMVYPYLPEEMRNPDSFKWMLQNPMYRQQLQDMLNNMGASPDQWDNRMVDHLKNFDLSSPEVRQQFAQVGMTPEEVVSKIMANPDVAVAFQNPKIQTAIMDCSQNPLNIVKYQNDKEVMDVFMKISQIFPQING

SEQ ID NO: 6898 - protein, 433 aa, Zea mays
MESLVLASSCSPSPRLPLLSPSARFRRLPGSMPQAPASTSGATRKGLRRHMLFVAAATATPSGSRNVFKELRAKGFASMSSSTANENMSTETGTLPPMPPPSSYIGSPVFWIGVGVALSVAFTTVSSMLKKYAMEQAFKSMMTQAPPNSFGSNSPFPFGMPPQASPTAPSSFSYLEPRKGTSPQVSTVDVSATEVDAAGTSKEVDVTETPKPSKNFAFVDVSPEDLQQKDLQSSLEMVDVKHDSTESESKEDTEEKAPRNGATFKLNEDAARGPTESSQSGPMLSVETIEKMMEDPAVQKMVYPYLPEEMRNPDSFKWMLQNPMYRQQLQDMLKNMGGSPDQWDNRMLDHLKNFDLSSPEVRQQFAQVGMTPEEVVSKIMANPDVAVAFQNPKIQTAIMDCSQNPLNIVKYQNDKEVMDVFMKISQIFPQING

SEQ ID NO: 6899 - protein, 433 aa, Setaria italica
MESLVLASSCSASPRLPVLSAAARFRGLPGAAPPTAASTGGAARGGARRPRLLVAAAAPRGSRNAFEGLRAKGFASVSSSTSNENTSTGTGTLPPMPPPSSYIGSPVFWIGVGVALSVAFTTVSSMVKKYAMQQAFKSMMSQSPSNSFGSNSPFPFAMPPQAAPTAPSSYPYPYSVPKKDTYPQAATVDVSATEVEAAGTSKEADVAETPKPSKKFAFVDVSPEELQQKNLQSSLETVDVKSDSTDSESKEDTEREVPTNGEAFKPNEGAARGPTESSNSGPMLSVETIEKMMEDPAVQKMVYPYLPEEMRNPDSFKWMLQNPMYRQQLQDMLNNMGSSPDQWDNRMVDHLKNFDLSSPEVRQQFAQVGMTPEEVVSKIMANPEVAVAFQNPKIQTAIMDCSQNPLNIVKYQNDKEVMDVFMKISQIFPQING

SEQ ID NO: 6900 - protein, 350 aa, Panicum virgatum
MRMCLLDTGTLPPMPPPSSYIGSPVFWIGVGVALSVAFTTVSSMVKRYAMQQAFKSMMTQSPSNSFGSNSPFPFAMPPQLAPTAPSSYPYSQPKRDTSPQVATVDVLATEVESSGTSKEADVAETPKPSKKFAFVDVSPEELQQKNLQSSLETVDVKRDSTDSESKEDTEQNVPTNGAAFKPNEDAARGPTESSNSGPMLSVETIEKMMEDPAVQKMVYPYLPEEMRNPDSFKWMLQNPMYRQQLQDMLNNMGGSSPDQGDNRMLDHLKNFDLSSPEVRQQFAQVGMTPEEVVSKIMANPEVAVAFQNPKIQTAIMDCSQNPLNIVKYQNDKEVMDVFMKISQIFPQING

SEQ ID NO: 6901 - protein, 431 aa, Pennisetum glaucum
MESLVLASSCSASPRLSAAARFRGLPGAAPPPSSAASIGGAARRGARRSRLLVAVAAAPRGSRNVFEGLRAKGFASMSSSTTNENTSTGTGTLPPMPPTSSYFGSPVFWIGVGVALSVAFTTVSSMVKKYAMQQAFKSMMSQSPSNSFGSNSPFPFAMPPQAAPTAPSSYPYSVPKKDTYPQAATVDVLATEVEAAGVSKEADVAETLKPSKKFAFVDVSPEELQQKNLQSSLETVDVKRDSADSESKEDTEQEVATNGASFKPNEDVARGPTESSNSGPMLSVETIEKMMEDPAVQKMVYPYLPEEMRNPDSFKWMLQNPMYRQQLEDMLNNMGGSPGQWDNRMVDHLKNFDLSSPEVRQQFAQVGMTPEEVVSKIMANPEVAVAFQNPKIQTAIMDCSQNPLNIVKYQNDKEVMDVFMKISQIFPQING

SEQ ID NO: 6902 - protein, 636 aa, Saccharum officinarum
MAKDYPASPKAQQLQESKKQRLTYILVVSALCIAFYVLGAWQNTTLPKPIGNSAITRVGCDPTVATAQSSGSVPSFGPGSGEMLDFDAHHQLTINNTDGDGELQQFPACPLNFSEYTPCEDRTRGRRFDRAMLVYRERHCPGKDEQVRCLIPAPPGYRTPFKWPHSRDYAYFNNIPHKELSIEKAVQNWIQVEGDKFKFPGGGTMFPRGADAYIDDIDKLISLSDGKIRTAVDTGCGVASLGAYLLKRNIIAMSFAPRDTHEAQVQFALERGVPAIIGVMGKHRLPYPSRAFDMAHCSRCLIPWHAHDGLYLAEVDRILRPGGYWILSGPPINWKTHHAGWERTKEDLKQEQDKIEDVARSLCWNKVVEKRDLSIWQKPKNHLECSNIKKTYKTPHICKSDNPDAAWYRQMEACVTPLPEVSNQGEVAGGAVEKWPERAFLVPPRIKRGMIPGLDAKKFDEDKKLWEKRVAYYKRTIPIAENRYRNVMDMNANMGGFAASLVKYPVWVMNVVPVNSDRDTLGAIYERGFIGTYQDWCEAFSTYPRTYDLLHADNLFSIYQDRCDITDILLEMDRILRPEGTAIIRDTVDVLTKVQAITKRMRWESRIMDHEDGPFNPEKVLMAVKTYWTAKAEEEN

SEQ ID NO: 6903 - protein, 638 aa, Setaria italica
MPKEYPASPKAQQLQESKKQRLTYILVVSALCIAFYVLGAWQNTTLPKPVGNSAAITRVGCDPATSTASSSASVPSFGPGSGEVLDFDAHHRLAINDTDAGAGLQQFPACPLNFSEYTPCEDRTRGRRFDRTMLVYRERHCPGKDEQVRCLIPAPPGYRTPFKWPKSRDYAYFNNIPHKELSIEKAVQNWIQVEGDKFRFPGGGTMFPRGADAYIDDINKLISLSDGQIRTAVDTGCGVASWGAYLLKRNIIAMSFAPRDTHEAQVQFALERGVPAIIGVMGKHRLPYPSRAFDMAHCSRCLIPWYAHDGLYLAEVDRILRPGGYWILSGPPINWKTHHKGWERTKDDLKQEQDKIEDVARSLCWNKVVEKGDLSIWQKPKNHLECANIKKTYKTPHICKSDNPDAAWYRQMEACVTPLPEVSNQGEVAGGAVERWPERAFIVPPRIRRGMIPGLDAKKFDEDKKLWEKRIAYYKRTIPIAENRYRNVMDMNANMGGFAASLVKYPVWVMNVVPVNSDRDTLGAIYERGFIGTYQDWCEAFSTYPRTYDLLHADNLFSIYQDRCDITDILLEMDRILRPEGTAIIRDTVDVLTKVQAITKRMRWESRIMDHEDGPFNPEKVLMAVKTYWTAKAPEDQN

SEQ ID NO: 6904 - protein, 638 aa, Panicum virgatum
MPKEYPASPKAQQLQESKKQRLTYILVVSALCIAFYVLGAWQNTTLPKPVSNSADITRVGCDPTTATAQSSGSVPSFGPGSGEALDFDAHHRLTINDTDAAAGLQQFPACPLNFSEYTPCEDRTRGRRFDRAMMVYRERHCPGKDEQIRCLIPAPPGYMTPFKWPKSRDYAYFNNIPHKELSIEKAVQNWIQVEGDKFRFPGGGTMFPRGADAYIDDINKLISLSDGTIRTAVDTGCGVASWGAYLLKRNIIAMSFAPRDTHEAQVQFALERGVPAIIGVMGKHRLPYPSRAFDMAHCSRCLIPWYEHDGLYLAEVDRILRPGGYWILSGPPINWKTHYKGWERTEDDLKQEQDKIEDVARSLCWKKVVEKRDLSIWQKPKNHLECANIKKTYKTPHICKSDNPDAAWYRQMEACVTPLPEVSNQGEVAGGAVEKWPERAFKVPPRIRRGMIPGLDAKKFDEDNKLWEKRMAYYKRIIPIAENRYRNVMDMNANMGGFAASLVKYPVWVMNVVPVNSDRDTLGAIYERGFIGTYQDWCEAFSTYPRTYDLLHADNLFSIYQDRCDITDILLEMDRILRPEGTAIIRDTVDVLTKVQAITKRMRWESRIMDHEDGPFNPEKVLMAVKTYWTAKASEEQN

SEQ ID NO: 6905 - protein, 634 aa, Setaria italica
MPKEYPASPKAQQLQESKKQRLTYILVVSALCIAFYVLGAWQNTTLPKPVGNSAAITRVGCDPATSTASSSASVPSFGPGSGEVLDFDAHHRLAINDTDAGAGLQQFPACPLNFSEYTPCEDRTRGRRFDRTMLVYRERHCPGKDEQVRCLIPAPPGYRTPFKWPKSRDYAYFNNIPHKELSIEKAVQNWIQVEGDKFRFPGGGTMFPRGADAYIDDINKLISLSDGQIRTAVDTGCGVASWGAYLLKRNIIAMSFAPRDTHEAQVQFALERGVPAIIGVMGKHRLPYPSRAFDMAHCSRCLIPWYAHDGLYLAEVDRILRPGGYWILSGPPINWKTHHKGWERTKDDLKQEQDKIEDVARSLCWNKVVEKGDLSIWQKPKNHLECANIKTPHICKSDNPDAAWYRQMEACVTPLPEVSNQGEVAGGAVERWPERAFIVPPRIRRGMIPGLDAKKFDEDKKLWEKRIAYYKRTIPIAENRYRNVMDMNANMGGFAASLVKYPVWVMNVVPVNSDRDTLGAIYERGFIGTYQDWCEAFSTYPRTYDLLHADNLFSIYQDRCDITDILLEMDRILRPEGTAIIRDTVDVLTKVQAITKRMRWESRIMDHEDGPFNPEKVLMAVKTYWTAKAPEDQN

SEQ ID NO: 6906 - protein, 634 aa, Oryza sativa
MAKEYPASPKAQQLQESKKQRLTYILVVSALCVAFYVLGAWQNTTVPKPAASSAITKVGCDPAAAGQSSAVPSFGSASQESLDFEAHHQLSLDDTGAEAAVQPFPACPLNFSEYTPCEDRKRGRRFERAMLVYRERHCPGKDEEIRCLIPAPPKYRTPFKWPQSRDFAWFNNIPHKELSIEKAVQNWIQVDGQRFRFPGGGTMFPRGADAYIDDIGKLISLTDGKIRTAIDTGCGVASWGAYLLKRNILAMSFAPRDTHEAQVQFALERGVPAIIGVMGKQRLPYPSRSFDMAHCSRCLIPWHEFDGIYLAEVDRILRPGGYWILSGPPINWKTHYKGWERTKEDLKEEQDNIEDVARSLCWNKVVEKGDLSIWQKPKNHLECANIKKKYKTPHICKSDNPDAAWYKQMEACVTPLPEVSNQGEIAGGALERWPQRAFAVPPRVKRGMIPGIDASKFEEDKKLWEKRVAYYKRTLPIADGRYRNVMDMNANLGGFAASLVKYPVWVMNVVPVNSDRDTLGAIYERGFIGTYQDWCEAFSTYPRTYDLLHADNLFSIYQDRCDITNILLEMDRILRPEGTAIIRDTVDVLTKVQAIAKRMRWESRILDHEDGPFNPEKVLVAVKTYWTADESEQH

SEQ ID NO: 6907 - protein, 631 aa, Brachypodium distachyon
MPKDYPASPKAQHLQESKKHRLTYILVVSSLCVAFYVLGAWQNTTMPKPVGNSAIARVDCDPTAQRDSSVPSFGSASETVLDFDAHHQLNLTDTEAVVQQFPACSLNFSEYTPCEDRKRGRRFEREMLAYRERHCPGKDEEIQCLIPAPPKYKNPFKWPQSRDFAWFDNIPHKELSIEKAVQNWIQVEGNKFRFPGGGTMFPHGADAYIDDIAKLISLSDGKIRTAIDTGCGVASWGAYLLKRNIIAMSFAPRDTHEAQVQFALERGVPAIIGVMGTQRLPYPSRAFDMAHCSRCLIPWGAYDGLYLAEVDRILRPGGYWILSGPPINWKTHQQGWQRTKEDLKQEQDKIENVARSLCWSKVVEKRDLSIWQKPKNHLECANIKKKYKIPHICKSDNPDAAWYKKMEACVTPLPEVSNQGSIAGGEVERWPERAFTVPPRVKRGTIPGIDVKKFVEDKKLSEKRLAYYKRTTPIAEGRYRNVMDMNANLGGFAASLVKYPVWVMNVIPVNSDKDTLGAIYERGFIGTYQDWCEAFSTYPRTYDLLHADNLFSIYQDRCDITNILLEMDRILRPEGTAIIRDTVDVLTKVQAITKRMRWESRILDHEDGPFNPEKVLVAVKTYWTADPSEHS

SEQ ID NO: 6908 - protein, 631 aa, Hordeum vulgare
MAKDYPASPKAQHLQESKKQRLTYILVVSALCVAFYVLGAWQNTTMPNPVSDSAISRVDCDPVARRDSSVPSFASASENVLDFDAHHQLNLSSTESVLQQFPACPLNQSEYTPCEDRKRGRLFDRDMLIYRERHCPGKDEQLRCLIPAPPKYKNPFRWPESRDFAWFDNIPHKELSIEKAVQNWIRVEGNKFRFPGGGTMFPHGADAYIDEISKLISLSDGRIRTAIDTGCGVASFGAYLLKRDIIAMSFAPRDTHEAQVQFALERGIPAILGVMGSLRLPYPSRAFDLAHCSRCLIPWGGHDGLYLAEIDRILRPGGYWIHSGPPINWRTHHNGWQRTEEDLKREQDKIEDVARSLCWNKVAEKEDLSIWQKPKNHLECADVKKKYKIPHICKSDNPDAAWYKKMESCLTPLPEVSNQGSIAGGEVARWPKRAFTVPPRVKRGTIPGIDANKFEEDMKLWEKRLTYYKRTTPIAQGRYRNVMDMNANLGGFAASLVKYPVWVMNVVPVNSDKDTLGAIYERGFIGTYQDWCEAFSTYPRTYDLLHADSLFSIYQDRCDITDILLEMDRILRPEGTAIIRDTVDVLTKVQAIGKRMRWDSRILDHEDGPFNPEKVLVAVKTYWTADPSEHS

SEQ ID NO: 6909 - protein, 415 aa, Secale cereale
MAKDYPASPKAQHLQESKKQRLTYVLVVSALCIAFYVLGAWQNTTMPNTVADSAISRVDCDTVAQRDGSVPSFAPASENVLDFDAHHQLNLSDTESAVQQFPACSLNQSEYTPCEDRKRGRLFDRDMLIYRERHCPGKDEQIRCLIPAPPKYKNPFRWPESRDVAWFDNIPHKELSIEKAVQNWIRVEGNKFRFPGGGTMFPHGADAYIDDISKLISLSDGRIRTAIDTGCGVASFGAYLLKRDIITMSFAPRDTHEAQVQFALERGVPAILGVMGSLRLPYPSRAFDLAHCSRCLIPWGGHDGLYLAEIDRILRPGGYWIHSGPPINWKTHHNGWQRTEEDLKREQDKIEDVARSLCWNKVAEKEDLSIWQKPKNHLECADIKKSTRYPICARVTTLMLPGTRRWNPVLLHCLK

SEQ ID NO: 6910 - protein, 170 aa, Saccharum officinarum
MAEDAPNAAAEGSQPAPPEGSADAAPPAATAGAKAAEALLPSLSIWPPSQRTRDAVVRRLVQTLAAPSVLSQRYGAVPEPEAERAAAAVEAEAFAAASKSAAAESPASVEEGIEVLQAYSKEVSRRLLELAKSRSAAAAAAPAEGSAKEEPEEDSLATAAATEEAAVKEE

SEQ ID NO: 6911 - protein, 173 aa, Sorghum bicolor
MAEDAPNAAAEGSQPAPPEGSADSAPAPAATAGAKAAEALLPSLSIWPPSQRTRDAVVRRLVQTLAAPSVLSQRYGAVPEPEAERAAAAVEAEAFAAASKSSSAAESPASVEEGIEVLQAYSKEVSRRLLELAKSRSAAAAAAPPAEGSAKEEPEEDSSAAAPATEEAAVKEE

SEQ ID NO: 6912 - protein, 164 aa, Setaria italica
MAEDAPNAAAEGTQPAPSEGSATAPASGAKAAEALLPSLSIWPPSQRTRDAVVRRLVQTLAAPSVLSQRYGAVPEPEAERAAAAVEAEAFAAASESAAGASPASVEEGIEVLQAYSKEVSRRLLELAKSRSAAAAAAPAEASAQDSEDSSATAPAPAEAAASEE

SEQ ID NO: 6913 - protein, 168 aa, Panicum virgatum
MAEDAPNAAAEATQPTPPEGSADADAAPPAPGAKAAEALLPSLSIWPPSQRTRDAVVRRLVQTLAAPSVLSQRYGAVPEPEAERAAAAVEAEAFAAASESAAGASPASVEEGIEVLQAYSKEVSRRLLELAKSRSAAAAAPAAEASAQESEESSATAAAPAESAASEE

SEQ ID NO: 6914 - protein, 198 aa, Sorghum bicolor
MKCWCVHAPRGAMATPLSSPFAPTTLRSPLRHRAPLLLLPFPPRAASSGEDTAAADQEPAPAATKTATADDDFEQRVLQIKSRVGPKKRGARKKKAAASSASANAVTLPPVPLREPRSALGAPVEFGFTAYSERLNGALAAVGLAAVLLVELGSGQALVKYHQPATLFLQAYTVAAAAALFVKYEKERISTWPGPPAK

SEQ ID NO: 6915 - protein, 1209 aa, Setaria italica
MSLAKKEEVCSHRLVPRLGEPAVGVPIKKRPVLLSDRSVASSMPLSIKPPSPVKDMPVSATGAGCGHESFFNIAKSDTNVITKGKGITDTQIQDHANRSFTSLSMTSGHGGLFNASSEIPSAESAARRFPPVVESQRQNFLALDLQLPSRQNGKDSNYGSIVKEEKVDQALSGLSSAEAHNNVHVASELNASSYSNSSDGRLPNLDLNVPLDPADSLEGLPTMHESGNGLFHHRTIQHQKAQVAPAAPISTTSNGVGQNVGSTVNMSNSFGLSHKCGPADVTLDLQLKPPTRPELGINWKGLVPAPELSLSLFGKPMDECKSLGAPNALFDSEIAGSSKKGSEETASTPGSDKVLVEKIVTPGPCNANPQDTTSATVSGIDQMTSHNLVKKEPEETPQQHILKGAEKAHLLERQSVVPASNCAESEMTDSPPQVPSRAGFDLNSEIFPNNGIHDGLNVATDNVPIPAESLLDITQAKTMPAVPEVEIDVKREESTNPVVAPVGGHSASLMEAKSLPSLSTVASPAVGLCESSSQPSVSTVCKPPARHVPVHADTTRRPCAANEACGALQGSSNPRAKSLLPNSRDNATIDGMSQGSAEMDCSDDEGNTVSRFPTTNKPHGESLGNGPTTKEDDINANNFCKELKKEQDSDMHEDCSSVTNKVNTQAVDGDKRIKTRVSVVSHAGEQGHRNEVFVTEKSKDKQSLNSGKNSPPTKTDNTMDDVKAATGSGSTDLQRPSALQKSTAPKLQPTRQSPKTSDLCLEKDRSSDIKSEMSPHGKQAASFNENHAKTAAVKMEHQTENEEVARHSDLQRRDSVLGKDSEVDGASSSQPHSECTKGKSAFEKLEHDKFQPDLCKTSPLQNERDGQLVGSHWRDLGHAYVNRNERWERFMESEREKNNGEWHGGRHASDMTNQRMTDHRGGWRGAGPRGHPRNFRGPRMRNEFADEPIGGRRRSFEDEPGHLNRVPHRRRRSPPPDSLMREVDIDGFHGREIPDHRLLAHGQIEDLPDDMMEDRFFMPRSHRHRGQGDHGFIQRDRSHSPAQRRGGHVHFHRGRSPEAMPRSPPLMRNERPYLSHCRHSRGHDERGGMQRNARRRGMEGDAFEPLLHPADLAELHAEEELTGRRKYTERRTYLRSSVSDEDEMLSYHTEDDMEFAEAGGGPREHDSRFRNRMAHDRARGEQEDGYRHRAHQGWRDGDSNDGRPKRRRY

SEQ ID NO: 6916 - protein, 198 aa, Setaria italica
MKCWCVHAARGGAMATPLSSPFAPTTILRSPLRHRALLLPFPPRAASSGEDTAEAVADQEGPATTKTATADDDFEERVLRIKSRVGPKKRGARKKKAGASAPANAVTLPPVPLREPRSALGAPVEFGFTAYSERLNGALAALGLAAVLLVELGSGQALVKYHQPATLFLQAYTVAAAAALFVKYEKERISTWPGPPAK

SEQ ID NO: 6917 - protein, 911 aa, Sorghum bicolor
MADEAISAACSCLEPLFGCLLQAAGREVAAFLRIKSNWGDLERARDSLRAVETTVRAAVAAEEDKLNVCDPEVEVWFKRVDELRPDTIDEDYSSLLGFSCLCQCTVHARRRASIGKRVVEALEEVKELTEQGRKFRTFGLKPPPRAVSRLSQTETVGLEPMLARLHDLLEKGESNIIGVWGQGGIGKTTLLHAFNNDLEKKDHNYQVVIFIEVSNSETLNTVEMQQTISDRLNLPWNELETVEKRARFLAKALARKRFLLLLDDVRKRFRLEDVGIPTPDTKSQSKLILTSRFQEVCFQMGAQRSRIEMKVLDDDAAWNLFLSKLSNETFEAVESPNFNKVVRDQARKIFFSCGGLPLALNVIGTAVAGLQGPKEWISAANDINVLNNEDVDEMFYRLKYSYDRLKPTQQQCFLYCTLFPEYGSISKEPLVNYWLAEGLLNDRQKGDQIIQSLISASLLQTSSSLSSKVKMHHVIRHMGIWLVNKTGQKFLVQAGMALDSAPPAEEWKEATRISIMSNDIKELLFSPECEILTTLLIQNNPNLNKLSSGFFKFMPSLKVLDLSHTAITSLPECETLVALQHLNLSHTRIRILPERLWLLKELRHLDLSVTAELEDTLNNCSKLLKLRVLNLFRSHYGISDVNDLNLDSLNALIFLGITIYAEDVLKKLNKTSPLAKSTYRLNLKYCRKMHSLKISDLNHLVHLEELYVESCYNLSTLVADADAELTTSGLEVLTLSVLPVLENVIVAPMPHHFRRIRKLAISSCPKLKNITWVLKLEMLERLVITSCDGLLKVVEEDSGDEAETKTEGQGGKWIGDGQSACNSGDNAHAEFLNLRSIELTDVKMLRSICKPRNFPSLETIRVEDCPNLRSIPLSSIYNFGKLKQVCCSVEWWEKLEWEDKEGKESKFFIPI

SEQ ID NO: 6918 - protein, 991 aa, Sorghum bicolor
MVGETGVGGQGGQREQCRHAHHPFDATPHRTHQARACGVLHARVLRLGLPLRGRLGDALVDLYGRSGRVGYAWRALGCCTGAPASGAAASSVLSCHARSGSPRDVLDAFQRLRCSIGGTPDQFGLAVVLSACSRLGALEQGRQVHCDVLKSGFCSSAFCQAGLVDMYAKCVEVKDARRVFDGIACPDTICWASMIAGYHRVGRYQQALALFSRMEKMGSAPDQVTYVTIISTLASMGRLSDARTLLKRIQMPSTVAWNAVISSYSQSGLESEVFGLYKDMKRQGLMPTRSTFASMLSAAASMTAFDEGQQIHAAAVKHGLDANVFVGSSLINLYVKHGCISDAKKVFDFSTEKNIVMWNAMLYGFVQNDLQEETIQMFQYMRRADLEADDFTFVSVLGACINLDSLDIGRQVHCITIKNSMDADLFVANAMLDMYSKLGAIDVAKALFSLIPGKDSVSWNALIVGLAHNEEEEEAVYMLKRMKCYGIAPDEVSFATAINACSNIRATETGKQIHCASIKYNVCSNHAVGSSLIDLYSKFGDVESSRKVLAHVDASSMVPINALITGLVQNNREDEAIELFQQVLKDGFKPSNFTFASILSGCTGPVSSVIGKQVHSYTLKSALLNQDTSLGISLVGIYLKCKLLEDANKLLAEVPDHKNLVEWTATISGYAQNGYSDQSLVMFWRMRSHDVRSDEATFASVLKACSEIAALTDGKEIHGLIIKSGFVSYETAASALMDMYSKCGDVISSFEIFKELKNKQNIMPWNSMIVGFAKNGYANEALLLFQKMQESQLKPDEVTLLGVLIACSHAGLISEGRNLFDSMSQVYGIVPRVDHYACLIDLLGRGGHLQEAQEVIDQLPFRADGVIWATFLAACQMHKDEERGKVAAKKLVEMEPQRSSTYVFLSSLHAAAGNWVEAKVAREAMREKGVMKFPGCSWITVGNKTNLFVVQDTHHPDTLGIYKMLDDLTGMMNKDDRIEEYDLRSLSEMLT

SEQ ID NO: 6919 - protein, 307 aa, Sorghum bicolor
MARKCSHCGNYGHNSRTCGLGHSREVMLCEAGDNGGGHGGSGLRLFGVQVRIGGGGAGSSASMKKSYSMDCLQLAAAQAGCSLVSPSSSSSSSLLLSIEEGLERGAAANGYLSDGPHGRVVQERKKGVPWSEEEHRQFLAGLEQLGKGDWRGISRNYVTTRTPTQVASHAQKFFLRQSSMGKKKRRSSLFDMVPICENSASISDPVSSEEGAGSTSLSLNVACHCHGAASDSERAALDLNSTEEGGDSRAAPGAGTTRPFPAPVAVAQTELLLHQPSSSSHGQGRGHHCSPLDLELGMSLPAPSIGT

SEQ ID NO: 6920 - protein, 270 aa, Saccharum officinarum
MLCEAGDNGGGSGLRLFGVQVRIGGGGGAGSSASMKKSYSMDCLQLAAPAGCSLVSPSSSSSSSLLLSIEEGLERGTANGYLSDGPHGRVVQERKKGVPWSEEEHRQFLAGLEKLGKGDWRGISRNYVTTRTPTQVASHAQKFFLRQSSMGKKKRRSSLFDMVPICENSASISDPLNSEGASTSLSLNVARHGAASDSERAALDLNSTEQDDSSRADASSASGAGSRQFPAAAAQTELLQPSSHGHGRGHHCSPGELELGMSLPTPSVGT

SEQ ID NO: 6921 - protein, 608 aa, Sorghum bicolor
MDKIQSDCPYPGCFFCVMKEANPSKRRASVLKFFRELPSQDDDGQVLPISGLWNTAMAHPNDPEFINLGIFECMAALIWKGLKNRRWLAHDQNIYIPYYAAHIIGSYTMNMEEFAERAVRAGVIPPLVELLRGRLTWVEQRVAVRALGHLATYPSTFPAVADHGEVLELAIQLASSSLEIVYSHFYQFVDRRLGYHCDLLTRGMGGVEMESRKAEEWASQLQCWSLQLINCFAFKPEFLHDICKPDFLVKLPGMWGGLVNENSPAGVGLLRTICQSKVGRGHVANIPGTIDALCNIARSSDDWQYMAVDCLIWLVQDASTCQKVIDKVAPTLIDLADISTLGDYKKLGDTIVTVLQECMQQSGNSRGAISAQTKAEIDELLRSKQSLKLEKSMPKEDLHIKQAAALVVKLEGNSLFSSGNIAGAAEKYSEALALCPMKSKKERVVLYSNRAQCYLLLQQPLAAISDATRALCLHSPVNRHAKSLWRRAQAYDMLGFAKESLLDAILFINECSQSNDPDLSLKQNKVPDYAERLVKKQMRAAWLFREAALKHGGVHCEGDASDAFGQEADDSEWETASESDAENDATGEADDETEWKNDGHQEDFCEKS

SEQ ID NO: 6922 - protein, 608 aa, Zea mays
MDKIQSDCPYPGCFFCVMKEANPSKRRASVLKYFRELPSQDDDGQVLPISGLWNTAMAHPNDPEFINLGIFECMASLIWKGLKNRRWLAHDQNIYIPYYAAHIIGSYTMNMEEFAERAVRAGVIPPLVELLRGRLTWVEQRVAVRALGHLATYPSTFPAVADHGEVLELAIQLASSSLEIVYSHFYQFVDRRLGYHCDLLTRGMGGVEMESRKAEEWASQLQCWSLQLINCFAFKPEFLHDICKPDFLVKLPGMWGGLVNENSPAGVGLLRTICQSKVGRGHVANIPATIDALCNIARSSDDWQYMAVDCLIWLMQDASTCHKVKDIVAPTLIDLSDISALGDYKKLGDTIVTVLQECMQQSGNSRGAIGVQTKSEIDELLRSKQSLKLEKSMPKEDLHIKQAAALVVKLEGNSLFSSGNIAGAAEKYSEALALCPMKSKKERVVLYSNRAQCYLLLQQPLAAISDATRALCLHSPVNRHAKSLWRRAQAYDMLGLAKESLLDAILFINECSQSNDPDLSLKQNKVPDYAERLVKKQMRSAWLFREAALKHGGVHCEGDASDAFGQDADDSEWETASESDAENDDTGEADDGTEWKNDGHREDICEKS

SEQ ID NO: 6923 - protein, 608 aa, Setaria italica
MDKIQSDCPYPGCFFCVMKEANPSKRRASVLKFFRELPSQDDDGQVLPISGLWNTAMAHPNDPEFINLGIFECMAALIWKGLKNRRWLAHDQNIYIPYYAAHIIGSYTMNVEEFAERAVRAGVIPPLVELLRGRLTWVEQRVAVRALGHLATYPSTFPAVAEHGEVLELAIQLASSSLEIVYSHFYQFVDRRLGYHCDLLTRGMGGVEMESRKAEEWASQLQCWSLQLINCFAFKPEFLHDICKADFLNKLPGMWGGLVNENSPAGVGLLRTICQNKVGRGHVANIPGTIDALCNIARSSDDWQYMAVDCLIWLVQDANTCHMVIDKVAPTLIDLTNISTLGDYKRLGDTIVTVLQECMQQSGNSRSTIRTQTKSEIDELLRSKQSLKLEKSMPREDLHIKQAAALVVKLEGNSLFSSGNIAGAAEKYSEALALCPMKSKKERVVLYSNRAQCYLLLQQPLAAISDATRALCLHSPVNRHAKSLWRRAQAYDMLGFAKESLLDAILFINECSQSNDPDLSLKQNKVPDYAERLVKKQMRAAWLFREASLKHGGVHCEGDASDAFGQEADDSEWETASESDAENDVRGEGDDETEWKNDGHQEDFCEKS

SEQ ID NO: 6924 - protein, 598 aa, Pennisetum glaucum
YPGCFFCVMKEANPSKRRASVLKFFRELPSQDDDGQVLPISGLWNTAMAHPNDPEFINLGIFECMAALIWKGLKNRRWLAHDQNIYIPYYAAHIIGSYTMNMEEFAERAVRAGVIPPLVELLRGRLTWVEQRVAVRALGHLATYPSTFPAVAEHGEVLELAIQLASSSLEIVYSHFYQFVDRRLGYHCDLLTRGMGGVEMESRKAEEWASQLQCWSLQLINCFAFKPEFLHDICKTDFLNKLPGMWGGLVNENSPAGVGLLRTICQNKVGRGHVANIPGTIDALCNIARSSDDWQYMAVDCLIWLVQDASTCHKVIDKVAPTLIDLANISTLGDYKRLGDTIVTVLQECMQQSGNSRSTISTQTKAEIDELLRSKQNLKMEKSMPKEDLHIKQAAALVVKLEGNSLFSSGNIAGAAEKYSEALALCPMKSKKERVVLYSNRAQCYLLLQQPLAAISDATRALCLHSPVNRHAKSLWRRAQAYDMLGFAKESLLDAILFINECSQSNDPDLSLKQNKVPDYAERLVKKQMRAAWLFREASLKHGGVHCEGDASDAFGQEADDSEWETASDSDAENDARGEDDDREWKNDGHQEDFCEKS

SEQ ID NO: 6925 - protein, 607 aa, Setaria italica
MDKIQSDCPYPGCFFCVMKEANPSKRKASVLKFFRELPSQDDDGQVLPISGLWNTAMAHPNDPEFINLGIFECMASLIWKGLKNRRWLAHDQNIYIPYYAAHIIGSYTMNMEEFAECAVRAGVIPPLVELLRGRLMWVEQRVAVRALGHLATYPSTFPAVADHGEVLELAIQLASSSLEIVYSHFYQFADQRLGYHCDLLTRGMGGVEMESRKAEEWASQVLCWSLQLINCFAFKPEFLHDICKADFLVKLPGMWGGLVNENSPAGVGLLRTICQSKVGRGHVANIPGTIDALCNIARSSDDWQYMAVDCLMWLVQDASTCHKVIDKVAPTLIDLADISTLGDYKKLGDTIVTVLQECMQQTGNSRGRISTQTKEAIDELLRCKQSLKLEKSMPKEDLYIKQAAALVVKLEGNSLFSSGNIAGAAEKYSEALALCPVKCKKERVVLYSNRAQCYLLLQQPLAAISDASRALCLHSPVNRHAKSLWRRAQAYDMLGFAKESLLDAILFINECSQSSDPDLSLKQNKVPDYAEQLVKKQMRVTWLFREAALKHGGVHCEGNASNAFGQEADDSEWETASESDAENDARREADDETEWKNHGLSLPGRFL

SEQ ID NO: 6926 - protein, 591 aa, Setaria italica
MKEANPSKRRASVLKFFRELPSQDDDGQVLPISGLWNTAMAHPNDPEFINLGIFECMAALIWKGLKNRRWLAHDQNIYIPYYAAHIIGSYTMNVEEFAERAVRAGVIPPLVELLRGRLTWVEQRVAVRALGHLATYPSTFPAVADHGEVLELAIQLASSSLEIVYSHFYQFVDRRLGYHCDLLTRGMGGVEMESRKAEEWASQLQCWSLQLINCFAFKPEFLHDICKADFLNKLPGMWGGLVNENSPAGVGLLRTICQNKVGRGHVANIPGTIDALCNIARSSDDWQYMAVDCLIWLVQDANTCHMVIDKVAPTLIDLTNISTLGDYKRLGDTIVTVLQECMQQSGNSRSTIRTQTKSEIDELLRSKQSLKLEKSMPREDLHIKQAAALVVKLEGNSLFSSGNIAGAAEKYSEALALCPMKSKKERVVLYSNRAQCYLLLQQPLAAISDATRALCLHSPVNRHAKSLWRRAQAYDMLGFAKESLLDAILFINECSQSNDPDLSLKQNKVPDYAERLVKKQMRAAWLFREASLKHGGVHCEGDASDAFGQEADDSEWETASESDAENDVRGEGDDETEWKNDGHQEDFCEKS

SEQ ID NO: 6927 - protein, 501 aa, Setaria italica
MDKIQSDCPYPGCFFCVMKEANPSKRKASVLKFFRELPSQDDDGQVLPISGLWNTAMAHPNDPEFINLGIFECMASLIWKGLKNRRWLAHDQNIYIPYYAAHIIGSYTMNMEEFAECAVRAGVIPPLVELLRGRLMWVEQRVAVRALGHLATYPSTFPAVADHGEVLELAIQLASSSLEIVYSHFYQFADQRLGYHCDLLTRGMGGVEMEWASQVLCWSLQLINCFAFKPEFLHDICKADFLVKLPGMWGGLVNENSPAGVGLLRTICQSKVGRGHVANIPGTIDALCNIARSSDDWQYMAVDCLMWLVQDASTCRKVIDKVAPTLIDLADISTLGDYKKLGDTIVTVLQECMQQTGNSRGRISTQTKEAIDELLRCKQSLKLEKSMPKEDLYIKQAAALVVKLEGNSLFSSGNIAGAAEKYSEALALCPVKCKKERVVLYSNRAQCYLLLQQPLAAISDASRALCLHSPVNRHAKSLWRRAQAYDMLGFAKESLLDAIFS

SEQ ID NO: 6928 - protein, 608 aa, Secale cereale
MDKIPSDCPYPGCFFCVMKEANPSKRRASVLKFFRELPSQDDDGQVLPISGLWNTAMAHPNDPEFINLGIFECMAALIWKGLKNRRWLSHDQNIYIPYYAAHVIGSYTMNMEEFAERAVRAGVIPPLVELLRGRLTWVEQRVAVRALGHLATYPSTFPAVADHGEVLELAIQLASSSLEIVYSHFYQFVDRRLGYHCDLLTRGMGGAEMESRKAEEWASQLQCWSLQLINCFAFKPEFLHDICKPEFLAKLPGMWGGLVNENSPAGVGLLRTICQSKLGRGHVANISGVIEALCNIARSSDDWQYMAIDCLLWLVQDPSTYHKVIDKIAPTMIDLADISTLGDYKRLGDTIVTVLQECMQQNGNSRNSISSHTKEEIDELLSFKQKLKSEKNMPKEDLHIKQAAALVVKLEGNSLFSSGNIEGAAAKYSEALALCPMKSKKERVVLHSNRAQCYLLLQQPLAAISDATRALCLHSPLNRHAKSLWRRAQAYDMLGLAKESLLDAILFINECSQSSDPDLSLRQNKVPDYAERLVKKQMRAAWLFRESSLKHGGIHCEGDASDAFGQEADDSEWETVSESDGEDDERREADDETEWKSGGHREDAYEKS

SEQ ID NO: 6929 - protein, 601 aa, Oryza sativa
MEKIQSDCPYPGCFFCVMKEANPSKRRASVLKFFRELPSQDDDGQVLPISGLWNTAMAHPNDPEFINLGIFECMSALIWKGLKNRRWLSHDQNIYIPYYAAHIIGSYTMNMEEFAERAVRAGVIPPLVELLRGRLTWVEQRVAVRALGHLATYPSTFPAVADHGEVLELAIQLASSSLEIVYSHFYQFVDRRIGYHCDLLTRGMGGVEMESRKAEEWASQLQCWSLQLINCFAFKSEFLHDICKADFLVKLPGMWGGLVNENSPAGVGLLRTICQSKLGRGHVANIPSVVEALCNIARSSDDWQYMAVDCLLWLVQDSNTCHKVIDRVASTLIDLANISMLGDYKKLGDTIVTVLQECMQQYANSRNSISTHTKEQIDELLSSKQSFKLEKNMPKEDLHIKQAAALVVKLEGNSLFSSGNIAGAAAKYSEALALCPMKSKKERVVLYSNRAQCYLLLQQPLAAISDATRALCLHSPLNRHAKSLWRRAQAYDMLGLAKESLLDAILFINECSQSNDPDLSLKQNKVPDYAERLVKKQMRTAWLFREAALKHGGIHCEGEASDAFGQEADDSEWETASESDAENDATGEADDETEWKNDNQV

SEQ ID NO: 6930 - protein, 608 aa, Brachypodium distachyon
MDKIQADCPYPGCFFCVMKEANPSKRRASVLKFFRELPSQDDDGQVLPISGLWNTAMAHPNDPEFINLGIFECMAALIWKGLKNRRWLSHDQNIYIPYYAAHVIGSYTMNMEEFAERAVRAGVITPLVELLRGRLTWVEQRVAVRALGHLATYPSTFAAVADHGEVLELAIQLASSSLEIVYSHFYQFVDRRLGYHCDLLTRGMGGAEMESRKAEEWASQLQCWSLQLINCFAFKPEFLHDICKPEFLAKLPGMWGGLVNENSPAGIGLLRTICQSKLGRGHVANISGVIEALCNIARSSDDWQYMAIDCLLWLVQDPSTYHKVIDKIAPALIDLADISTLGDYKKLGDTIVTVLQECMQQNGNSRSSVSSHTREEIDELLSSRQKLKSEKNMPKEDLHIKQAAALVVKLEGNSLFSSGNIEGAATKYSEALALCPMKSKKERVVLYSNRAQCYLLLQQPSAAISDATRALCLHSPLNRHAKSLWRRAQAYDMLGLAKESLLDAILFINECSQSSDPDLSLRQNKVPDYAERLVKKQMRAAWLFRASSLKHGGIHCEGDASDAFGQEADDSEWETVSESDGENDERREADDETEWKNGSHWEDVYAKS

SEQ ID NO: 6931 - protein, 309 aa, Oryza sativa
MKEANPSKRRASVLKFFRELPSQDDDGQVLPISGLWNTAMAHPNDPEFINLGIFECMSALIWKGLKNRRWLSHDQNIYIPYYAAHIIGSYTMNMEEFAERAVRAGVIPPLVELLRGRLTWVEQRVAVRALGHLATYPSTFPAVADHGEVLELAIQLASSSLEIVYSHFYQFVDRRIGYHCDLLTRGMGGVEMESRKAEEWASQLQCWSLQLINCFAFKSEFLHDICKADFLVKLPGMWGGLVNENSPAGVGLLRTICQSKLGRGHVANIPSVVEALCNIARSSDDWQYMAVDCLLWLVQDSNTCHKVGH

SEQ ID NO: 6932 - protein, 608 aa, Brachypodium distachyon
MDKIQSDCPYPGCFFCVMKEANPSKRRASVLKFFRELPSQDDDGQVLPISGLWNTAMAHPNDPEFINLGIFECMAALIWKGSKNRRWLSHDQNIYIPYYAAHVIGSYTMNMEEFAERAVRAGVIPPLVELLRGRLTWVEQRVAVRALGHLATYPSTFPAVADHGEVLELAVQLASSSLEIVYSHFYQFVDRRLGYHCDLLTRGMGGAEMESRKAEEWGSQLQCWSLQLINCFAFKPEFLHDICKPEFLAKLPGMWGGLVNENSPAGIGLLRTICQSKVGRGHVANISGVLEALCNISHSSDDWQYMAIDCILWLVQDPSTYHKVIDKIAPTLIDLADISTLGDYKKLGDTIVTVLQECMQQNNNSRNSVSSHTIEKIEELLSSRQKLKSERNMPKEDLHIKQAAALVVKLEGNSLFSSGNIEGAATKYSEALALCPMKSKKERVVLYSNRAQCYLLLQQPLAAISDATRALCLHSPLNRHAKSLWRRAQAYDMLGLAKESLLDAILFINECSQSSDPDLSSRQNKVPDYAERLVKKQMRAAWLFRESSLKHGGIHCEGDASDAFGQEVDDSEWETVGESDGENDERREVDDETEWKNAGHREDAFEKS

SEQ ID NO: 6933 - protein, 309 aa, Brachypodium distachyon
MKEANPSKRRASVLKFFRELPSQDDDGQVLPISGLWNTAMAHPNDPEFINLGIFECMAALIWKGLKNRRWLSHDQNIYIPYYAAHVIGSYTMNMEEFAERAVRAGVITPLVELLRGRLTWVEQRVAVRALGHLATYPSTFAAVADHGEVLELAIQLASSSLEIVYSHFYQFVDRRLGYHCDLLTRGMGGAEMESRKAEEWASQLQCWSLQLINCFAFKPEFLHDICKPEFLAKLPGMWGGLVNENSPAGIGLLRTICQSKLGRGHVANISGVIEALCNIARSSDDWQYMAIDCLLWLVQDPSTYHKVRH

SEQ ID NO: 6934 - protein, 76 aa, Elaeis guineensis
MDKISSDCPYPGCFFCVMKEGNPNKRRTSILKFFRELPSQDDDGQVLPISGLWNTAMAHPNDPEFVNLGILNAWLH

SEQ ID NO: 6935 - protein, 628 aa, Ricinus communis
MDKVSPDCPYPGCFFCVMKEGNPSKRRASILKFFRELPSQDDDGQVLPISGLWNTAMAHPNDPEFIELGIFECMAALIWKGLKNRRWLSHDQNIYIPYYAAHIIGSYTMNMEEFAESAVHAGVIPPLVELLRGRLTWVEQRVAVRALGHLATYASTFPAVASQGEILELSIQLAMSSLEIVYSHFYQYVDRRLSYHCDLLTRGMGGVEMESRKAEEWASQLQCWSLQLINCFAFKPEFLPTICKPEFLVKLPGMWGGLVNENSPAGIGLLRTICHHKLGRGPVASCPGIIEALCNIARSSDDWQYMAIDCLLWLLQDPSTCHKVIDKAVPALIDLSEISTLGDHKKLGDSIVNVLQDCIQSQGTGRSSISNRTKELIEELLTSKQRLKWEKNMPKEDLHIKQAAALVVKLEGNSLFSSGNISGAASKYSEALSLCPMRSKKERVVLYSNRAQCHLLLQQPLAAISDATRALCLHNPLNRHAKSLWRRAQAYDMLGLAKESLLDAILFINECSQSNDPDLCLRQNKVPDYAERLVKKQMRAAWLFREAAIKHGGVHGEGDGEIYGQDSDDSEWETASESDIGNDGRDEMGDDDDDSEWKNEDERKDKYDKPSLKDIKHGYNLQLVEDDS

SEQ ID NO: 6936 - protein, 630 aa, Populus trichocarpa
MDKVSPDCPYPGCFFCVMKEGNPSKRRASILKFFRELPSQDDDGQVLPISGLWNTAMAHPNDPEFIELGIFECMVALIWKGLKNRRWLSHDQNIYIPYYAAHIIGSYTMNMEEFAESAIHAGVTPPLVELLRGRLTWVEQRVAVRALGHLATYTNTFPAVASHGEILELAIQLAMSSLEIVYSHFYQYADRRLSYHCDLLTRGMGGVEMESRKAEEWASQLQCWSLQLINCFAFKPEFLPTICKPEFLVKLPGMWGGLVNENSPAGIGLLRTICHHKLGRGPVASCPGIIEALCNIARSSDDWQYMAIDCLLWLIQDPSTCHKVIDKAVPALVDLAEITNLGDHKKLGDYIVNVLQECLQSQGTGRNSISNHVKELIEELLNSKQRLKWEKSMPKEDLHIKQAAALVVKLEGNSLFSSGNIAGAASKYSEALSLCPMRSKKERVVLYSNRAQCHLLLQQPLAAISDATRALCLHSPLNRHAKSLWRRAQAYDMLDLAKESLLDAILFINECSQSNDPDLSLRQNKVPDYAERLVKKQMRAAWLFREAAIKHGGVHGEGDAGDIYGQESDGSEWETASESDIGNDGRAEMGDDDDDDSEWKNEDKRKDKYDKVTLKDLKHGYNVHLAEDQS

SEQ ID NO: 6937 - protein, 627 aa, Cajanus cajan
MDKVSSDCPYPGCFFCVMKEGNPSKRRASVLKFFRELPCQDDDGQVLPISGLWNTAMAHPNDPEFIELGIFECMSALIWKGLKNRRWLSHDQNIYIPYYAAHIIGSYTMNMEEFAENAVHAGVIPPLVELLRGRLTWVEQRVAVRALGHLATYASTFPAIASHGEILELSIQLAMSSLEIVYSHFYQYVDRRLSYHCDLLTRGMGGVEMESRKAEEWASQLQCWSLQLINCFAFKQEFLPTICKPEFLTKLPGMWGGLVNENSPAGIGLLRTICHQKLGRGPVASCPGIIDALCNIAQSSDDWQYMAIDCLLWLLQDPNTCHKVIDKVVPALVDLAEITTLGDHKKLGDSIVNVLQECIQSQGSGRSSTSSRTKEQIEDILNSKQRLKWEKSMPKEDLHIKQAAALVVKLEGNSLFSSGNISGAASKYSEALALCPMRSRKERVVLYSNRAQCYLLLQQPLAAISDATRALCLHKPVNRHAKSLWRRAQAYDMLGLAKESLLDAILFINECSQSNDPDLSLRQNKVPDYAERLVKKQMRAAWLFREAAIKHGGVHSQGDGGDMYGPETDDSEWETASESDIGNDGRDDMGDDDDGDWNNDDERKDYDKPSMKDIKHGYNVQLAEEEP

SEQ ID NO: 6938 - protein, 630 aa, Manihot esculenta
MDKVSPDCPYPGCFFCVMKEGNPSKRRASILKFFRELPSQDDDGQVLPISGLWNTAMAHPNDPEFIELGIFECMAALIWKGLKNRRWLSHDQNIYIPYYAAHIIGSYTMNMEEFAESAVHAGVIPPLVELLRGRLTWVEQRVAVRALGHLATYASTFPAVASHGEILELSIQLAMSSLEIVYSHFYQYVDRRLSYHCDLLTRGMGGVEMESRKAEEWASQLQCWSLQLINCFAFKPEFLPTICKPEFLVKLPGMWGGLVNENSPAGIGLLRTICHHKLGRGPVASCPGIIEALCNIARSSDDWQYMAIDCLLWLLQDPNTCHKVIDKAVPALIDLADITALGDHKKLGDSIVNVLQDCIQSLGTGRNSVSNRTKELIEELLNSKQRLKWEKNMPKEDLHIKQAAALVVKLEGNSLFSSGNISGAASKYSEALSLCPMRSKKERVVLYSNRAQCHLLLQQPLAAISDATRALCLHNPLGRHAKSLWRRAQAYDMLGLAKESLLDAILFINECSQSNDPELCLRQNKVPDYAERLVKKQMRAAWLFREAAIKHGGVHCEGDAVDVYGQDTDDSEWETASESDIGNDGRDEMGNDDDDDSEWKNEDERKDKYDKPSLKEIKHVYNVQLAEDES

SEQ ID NO: 6939 - protein, 630 aa, Theobroma cacao
MDKVSPDCPYPGCFFCVMKEGNPSKRRASILKFFRDLPSQDDDGQVLPISGLWNTAMAHPNDPEFIELGIFECMAALIWKGLKNRRWLSHDQNIYIPYYAAHIIGSYTMNMEEFAESAVHASVIPPLVELLRGRLTWVEQRVAVRALGHLATYTSTFPAVASHGEILEVSIQLAMSSLEIVYSHFYQYVDRRLSYHCDLLTRGMGGVEMESRKAEEWASQLQCWSLQLINCFAFKPEFLPTICKPEFLVKLPGMWGGLVNENSPAGIGLLRTICHHKLGRGPVASCPGIIEALCNIARSSDDWQYMAIDCLLWLLQDPSTCHKVIDKAVPALVDLAEITTLGDHKKLGDSIVNVLQECIQSQGTGRSSLSNRTKELIEELLSSRQRLKWEKNMPKEDLHIKQAAALVVKLEGNSLFSSGNISGAASKYSEALSLCPMRSKKERVVLYSNRAQCHLLLQQPSAAISDATHALCLHNPLNRHAKSLWRRAQAYDMLGLAKESLLDAILFINECSQSNDPDLSLRQNKVPDYAERLVKKQMRAAWLFREAAIKLGGVHCEGDAGDMYGQDTDDSEWETASESDIGNDGRDEMGDDDDDDDSEWKNEDERKDKYEKPSMKDIKHGFNVQLTDEP

SEQ ID NO: 6940 - protein, 630 aa, Gossypium raimondii
MDKASPDCPYPGCFFCVMKEGNPSKRRASILKFFRDLPSQDDDGQVLPISGLWNTAMAHPNDPEFIELGIFECMSALIWKGLKNRRWLSHDQNIYIPYYAAHIIGSYTMNMEEFAESAVHAGVIPPLVELLRGRLTWVEQRVAVRALGHLATYTSTFPSVASHGEILEVAIQLAMSSLEIVYSHFYQYVDRRLSYHCDLLTRGMGGVEMESRKAEEWASQLQCWSLQLINCFAFKPEFLPTICKPEFLVKLPGMWGGLVNENSPAGIGLLRTICHHKIGRGSVASCPGIIEALVNIACSSDDWQYMAIDCLLWLLQDPSTCHKVIDKAVPALVDLAEITTLGDHKKLGDTIVNVLQECIQSQGTGRSSVSNRTKELIEELLSSRQRLKWEKNIPKEDLHIKQAAALVVKLEGNSLFSSGNIAGAASKYSEALSLCPMRSKKERVVLYSNRAQCHLLLQQPLAAISDATRALCLHNPLNRHAKSLWRRAQAYDMLGLAKESLLDAILFINECSQSNDPDLSLRQNKVPDYAERLVKKQMRAAWLFREAAIKLGGVHCEGDAGDMYGQDTDDSEWETASESDIGNDGRDEMGDEDDDDSEWKNEDERKAKFKKPSMKDIKHGFNVQLTEDEP

SEQ ID NO: 6941 - protein, 630 aa, Gossypium hirsutum
MDKASPDCPYPGCFFCVMKEGNPSKRRASILKFFRDLPSQDDDGQVLPISGLWNTAMAHPNDPEFIELGIFECMSALIWKGLKNRRWLSHDQNIYIPYYAAHIIGSYTMNMEEFAESAVHAGVIPPLVELLRGRLTWVEQRVAVRALGHLATYTSTFPSVASHGEILEVAIQLAMSSLEIVYSHFYQYVDRRLSYHCDLLTRGMGGVEMESRKAEEWASQLQCWSLQLINCFAFKPEFLPTICKPEFLVKLPGMWGGLVNENSPAGIGLLRTICHHKIGRGSVASCPGIIEALVNIACSSDDWQYMAIDCLLWLLQDPSTCHKVIDKAVPALVDLAEITTLGDHKKLGDTIVNVLQECLQSQGMGRSSVSNRTKELIEELLSSRQRLKWEKNIPKEDLHIKQAAALVVKLEGNSLFSSGNIAGAASKYSEALSLCPMRSKKERVVLYSNRAQCHLLLQQPLAAISDATRALCLHNPLNRHAKSLWRRAQAYDMLGLAKESLLDAILFINECSQSNDPDLSLRQNKVPDYAERLVKKQMRAAWLFREAAIKLGGVHCEGDAGDMYGQDTDDSEWETASESDIGNDGRDEMGDEDDDDSEWKNEDERKAKFKKPSMKDIKHGFNVQLTEDEP

SEQ ID NO: 6942 - protein, 626 aa, Phaseolus coccineus
MDKVSSDCPYPGCFFCVMKEGNPSKRRASVLKFFRELPCQDDDGQVLPISGLWNTAMAHPNDPEFIELGIFECMSALIWKGLKNRRWLSHDQNIYIPYYAAHIIGSYTMNMEEFAESAVHAGVIPPLVELLRGRLTWVEQRVAVRALGHLATYASTFPAIASNGEILELSIQLAMSSLEIVYSHFYQYVDRRLSYHCDLLTRGMGGVEMESRKAEEWASQLQCWSLQLINCFAFKHEFLPTICKPEFLIKLPGMWGGLVNENSPAGIGLLRTICHQKLGRGPVASCPGIIDALCNIARSSDDWQYMAIDCLLWLLQDPNTCHKVIDKVVPVLVDLAEITTLGDHKKLGDSIVSVLQECIQSQGSGRSSISSRTKEQIEDILNSKQRLKWEKNMPKEDLHIKQAAALVVKLEGNSLFSSGNISGAASKYSEALSLCPMRSRKERVVLYSNRAQCHLLLQQPLTAISDATRALCLHKPVNRHAKSLWRRAQANDMLGLAKESLLDAILFINECSQSNDPDLSLRQNKVPDYAERLVKKQMRAAWLFREAAVKHGGVHSQGDGGDMYGPETDDSEWETASESDIGNDGRDDMGDDDDGDWNNDESKAYDKPSMKDIKHGYNVQLAEEEP

SEQ ID NO: 6943 - protein, 621 aa, Glycine max
MDKVSSDCPYPGCFFCVMKEGNPSKRRASVLKFFRELPCQDDDGQVLPISGLWNTAMAHPNDPEFLELGIFECMSALIWKGLKNRRWLSHDQNIYIPYYAAHIIGSYTMNMEEFAESAVHAGVIPPLVELLRGRLTWVEQRVAVRALGHLATYASTFPAIASHGEILELSIQLAMSSLEIVYSHFYQYVDRRLSYHCDLLTRGMGGVEMESRKAEEWASQLQCWSLQLINCFAFKHEFLPTICKPEFLIKLPGMWGGLVNENSPAGIGLLRTICHQKLGRGPVASCPGIIDALCNIARSSDDWQYMAIDCLLWLLEDPNTCHKVIDKVVPALVDLAEITTLGDHKKLGDLVVNVLQECIQSQGSGRSSISSHTKEQIEDILNSKQRLKWEKNMPKEDLHIKQAAALVVKLEGNSLFSSGSIAGAASKYSEALALCPMRSRKERVVLYSNRAQCHLLLQQPLAAISDATRALCLHKPVNRHAKSLWRRAQAYDMLGLAKESLLDAILFINECSQSNDPDLSLRQNKVPDYAERLVKKQMRAAWLFREAAIKHGGVHSQGDGGDMYGPETDDSEWETASESDIGNDGRDDMGEDDDGDWNNDDERKNYDKPSMKASLDHPSER

SEQ ID NO: 6944 - protein, 627 aa, Glycine max
MDKVSSDCPYPGCFFCVMKEGNPSKRRASVLKFFRELPCQDEDGQVLPISGLWNTAMAHPNDPEFIELGIFECMSALIWKGLKNRRWLSHDQNIYIPYYAAHIIGSYTMNMEEFAESAVHAGVIPPLVELLRGRLTWVEQRVAVRALGHLATYASTFPAIASHGEILELSIQLAMSSLEIVYSHFYQYVDRRLSYHCDLLTRGMGGVEMESRKAEEWASQLQCWSLQLINCFAFKHEFLPTICKPEFLIKLPGMWGGLVNENSPAGIGLLRTICHQKLGRGPVASCPGIIDALCNIARSSDDWQYMAIDCLLWLLQDPNTCHKVIDKVVPVLVDLAEITTLGDHKKLGDSILNVFQECIQSQGSGRSSISSHTKEQIEDILDSKQRLKWEKNMPKEDLHIKQAAALVVKLEGNSLFSSGNIAGAASKYSEALALCPMRSRKERVVLYSNRAQCHLLLQQPLAAISDATRALCLHRPVNRHAKSLWRRAQAYDMLGLAKESLLDAILFINECSQSNDPDLSLRQNKVPDYAERLVKKQMRSAWLFREAAIKHGGVHSQGDGGDMYGPETDDSEWETASESDIGNDGRDDMGDDDDGDWNNDDQRKDYDKPSMKDIKHGYNVQLAEEEP

SEQ ID NO: 6945 - protein, 617 aa, Quercus alba
MDKVSSDCPYPGCFFCVMKEGNPSKRRASILKFFRELPSQDDDGQVLPISGLWNTAMAHPNDQEFIDLGIFECMAALIWKGLKNRRWLSHDQNIYIPYYAAHIIGSYTMNMEEFADSAVHAGVIPPLVELLRGRLTWVEQRVAVRALGHLATYSSTFPALASHGEILELSIQLAMSSLEIVYSHFYQYVDRRLSYHCDLLTRGMGGVEMESRKAEEWASQLQCWSLQLINCFAFKPEFLSTICKPEFLIKLPGMWGGLVNENSPAGIGLLRTICHHKLGRGPVASCTGIIEALCNIARSSDDWQYMAIDCLLWLLQDPSTCHKVIDKAVPALVDLAEISALGDHKKLGDTIVSVLQECIQSQGNGRNSLSNRTKEQIEELLNSRQRLKWEKSMPKEDLHIKQAAALVVKLEGNSLFSSGNISGAASKYSEALALCPMRSKKERVVLYSNRAQCYLLLQQPLFAISDATRALCLHNPLNRHAKSLWRRAQAYDMLGLAKESLLDAILFINECSQSNDPDLSLRQNKVPDYAERLVKKQMRAAWLFREAAIKHGGVHCEGDAGDIYGRETDDSEWETASESDIGNDGRDEMGDDDDDDSEWKNEDERKDKYDKPSIKEP

SEQ ID NO: 6946 - protein, 630 aa, Gossypium hirsutum
MDKASPDCPYPGCFFCVMKEGNPSKRRASILKFFRDLPSQDDDGQVLPISGLWNTAMAHPNDPEFIELGIFECMSALIWKGLKNRRWLSHDQNIYIPYYAAHIIGSYTMNMEEFAESAVHAGVIPPLVELLRGRLTWVEQRVAVRALGHLATYTSTFPSVASHGEILEVAIQLAMSSLEIVYSHFYQYVDRRLSYHCDLLTRGMGGVEMESRKAEEWASQLQCWSLQLINCFAFKPEFLPTICKPEFLVKLPGMWGGLVNENSPAGIGLLRTICHHKIGRGSVASCPGIIEALVNIACSSDDWQYMAIDCLLWLLQDPSTCHKVIDKAVPALVDLAEITTLGDHKKLGDTIVNVLQECLQSQGTGRSSVSNRTKELIEELLSSRQRLKWEKNIPKEDLHIKQAAALVVKLEGNSLFSSGNIAGAASKYSEALSLCPMRSKKERVVLYSNRAQCHLLLQQPLAAISDATRALCLHNPLNCHAKSLWRRAQAYDMLGLAKESLLDAILFINECSQSNDPDLSLRQNKVPDYAERLVKKQMRAAWLFREAAIKLGGVHCEGDAGDMYGQDTDDSEWETASESDIGNDGRDEMGDEDDDDSEWKNEDERKAKFKKPSMKDIKHGFNVQVTEDEP

SEQ ID NO: 6947 - protein, 630 aa, Gossypium hirsutum
MDKASPDCPYPGCFFCVMKEGNPSKRRASILKFFRDLPSQDDDGQVLPISGLWNTAMAHPNDPEFIELGIFECMSALIWKGLKNRRWLSHDQNIYIPYYAAHIIGSYTMNMEEFAESAVHAGVIPPLVELLRGRLTWVEQRVAVRALGHLATYTSTVPSVASHGEILEVAIQLAMSSLEIVYSHFYQYVDRRLSYHCDLLTRGMGGVEMESRKAEEWASQLQCWSLQLINCFAFKPEFLPTICKPEFLVKLPGMWGGLVNENSPAGIGLLRTICHHKIGRGSVASCPGIIEALVNIACSSDDWQYMAIDCLLWLLQDPSTCHKVIDKAVPALVDLAEITTLGDHKKLGDTIVNVLQECIQSQGTGRSSVSNRTKELIEELLSSRQRLKWEKNIPKEDLHIKQAAALVVKLEGNSLFSSGNIAGAASKYSEALSLCPMRSKKERVVLYSNRAQCHLLLQQPLAAISDATRALCLHNPLNRHAKSLWRRAQAYDMLGLAKESLLDAILFINECSQSNDPDLSLRQNKVPDYAERLVKKQMRAAWLFREAAIKLGGVHCEGDAGDMYGQDTDDSEWETASESDIGNDGRDEMGDEDDDDSEWKNEDERKAKFKKPSMKDIKHGFNVQLTEDEP

SEQ ID NO: 6948 - protein, 606 aa, Cicer arietinum
MDKVSSDCPYPGCFFCVMKEANPSKRRSSVLKFFRELPCQDDDGQVLPISGLWNTAMAHPNDPEFIELGIFECMSALIWKGLKNRRWLSHDQNIYIPYYAAHIIGSYTMNMEEFAESAIHAGVIPPLVELLRGRLTWVEQRVAVRALGHLATYASTFPAVASHGEILELSIQLAMSSLEIVYSHFYQYADRRLSYHCDLLTRGMGGVEMESRKAEEWASQLQCWSLQLINCFAFKPEFLPTICKQEFLTKLPGMWGGLVNENSPAGIGLLRTICHQKLGRGPVASCPGIIEALCNIARSSDDWQYMAIDCLLWLLQDPNTCHKVIDKVVPSLVDLAEITTLGDHKKLGDSIVNVLQDCIQSQGSGRSSISSRTKEQIEDLLSSKQRLKWEKNMPKEDLHIKQAAALVVKLEGNSLFSSGNISGAASKYSEALALCPMRSKKERVVLYSNRAQCYLLLQQPLAAISDATCALCLHRPVNRHAKSLWRRAQAYDMLGLAKESLLDAILFINECSQSNDPDLSLRQNKVPDYAERLVKKQMRAAWLFREAAVKHGGVHSQGDGGEIYGPETDDSEWETASESDMGNDGIGDDDDDDGDWNNDDDDERKD

SEQ ID NO: 6949 - protein, 635 aa, Prunus persica
MDKVSSDCPYPGCFFCVMKEGNPSKRRASILKFFRELPAQDDDGQVLPISGLWNTAMAHPNDPEFIELGIFECMAALIWKGLKNRRWLSHDQNIYIPYYAAHIIGSYTMNMEEFAESAVHAGVIPPLVELLRGRLTWVEQRVAVRALGHLATYASTFPAVASHGEILELSIQLAMSSLEIVYSHFYQYVDRRLSYHCDLLTRGMGGVEMESRKAEEWASQLQCWSLQLINCFAFKPEFLPTICKPEFLTKLPGMWGGLVNENSPAGIGLLRTICHHKLGRGPVASCPGIIESLCNIARSSDDWQYMTIDCLLWLLQDPSTCHKVIDKAVPALVDLAEITTLGDHKKLGDSIVNVLEECVQSQGTGRNSFSNRTKELIEELLNSRQRLKWEKNMPKEDLHIKQAAALVVKLEGNSLFSSGNISGAASKYSEALALCPMRSKKERVVLYSNRAQCHLLLQQPLAAISDATRALCLHNPLNRHAKSLWRRAQAYDMLGLAKESLLDAILFINECSQSNDPDLSLRQNKVPDYAERLVKKQMRAAWLFREAAIKHGGVHCEGDAGDIYGRETDDSEWETASESDIGNDGRDEMGNDDDDDEDDDDSEWKNDDERKEKYDKSSMKDLKHGYNVQLAEDEP

SEQ ID NO: 6950 - protein, 546 aa, Papaver somniferum
MAHPNDPEFIDLGIFECMSALICKGLKNRRWLSHDQNIYIPYYAAHIIGSYTMNMEEFAESAVHAGVIPPLVELLRGRLTWVEQRVAVRALGHLATYASTFPSVANHGEVLELSIQLAMSSLEIVYSHFYQQMDRRLNYHCDLLTRGMGGVEMESRKAEEWASQLQCWSLQLINCFAFKPEFLSIICKPEFLVKLPGMWGGLVNENSPAGIGLLRTICHHKLGRGHVANCPGIVEALCNIARSSDDWQYMAIDCLIWLLQDPATCHKVTDKAVPALIDLAEISTLGDHKKLGESIVNVLQECVESPGTGRTSISTRTKEQIDELLNSRQRLKWEKNMPKEDLHIKQAAALVVKLEGNSLFSSGNISGAASKYSEALALCPMRSKKERVVLYSNRAQCHLLLQQPLTAISDATRALCLHNPLNRHAKSLWRRAQAYDMLGLAKESLLDAILFINECSQSNDPDLSLKQNKVPDYAERLVKKQMRAAWLFTEAATKHGGVSCEGEGGGNVYGQEADDSEWETASESDIGDDGRADMGDGDSELDAEER

SEQ ID NO: 6951 - protein, 593 aa, Amorphophallus konjac
MDKVSPDCPYPGCFFCVMKEGNPNKRRTSILKFFRELPAQDDDGQVLPISGLWNTAMAHPNDPEFIDLGIFECMAALIWKGLKNRRWLSHDQNIYIPYYAAHIIGSYTMNMEEFAESAVHAGVIPPLVELLRGRLTWVEQRVAVRALGHLATYASTFPAVASHGEVLELSIQLALSSLEIVYSHFYQYPDRRLSYHCDLLTRGMGGVEMESRKAEEWASQLQCWSLQLINCFAFKPEFLSVICKPDFLLKLPGMWGGLVNENSPAGIGLLRTICHHKPGRGPVASLPGIIEALCNIARSSDDWQYMAIDCLLWLLQDPTTCHKVVDKVVPALIDLSEISTLGDHKKLGDTIVCVLQECIQGQGNGRASISSNTKKQIDELVNSRERLKWEKKMPKEDLHIKHAAALVVKLEGNSLFSSGNIAGAASKYSEALDLCPIRSKKERVVLFSNRAQCYLLLQQPLAAISDATRALCLHNPINRHAKSLWRRAQAYDMLGLAKESLLDAILFINECSQSNDPDLSLRQNKVPDYAERLVKKQMRAAWLFREAAVKHGGVHCDSDAGDVYGQEADNSEWETASESDLENDEREQGDDDN

SEQ ID NO: 6952 - protein, 619 aa, Aristolochia fimbriata
MDKITADCPYPGCFFCVMKEANPSKRRTSILKFFRELPSQDDDGQVLPISGLWNTAMAHPNDPEFIDLGIFECMAALIWKGLKNRRWLSHDQNIYIPYYAAHIIGSYTMNMEEFAESAVHAGVIPPLVELLRGRLTWVEQRVAVRALGHLATYPSTFPAVANHGEILELSIQLAISSLEIVYSHFYQYVDRRLGYHCDLLTRGMGGVEMESRKAEEWASQLQCWSLQLINCFAFKPDFLPIICKSDFLIKLPGMWGGLVNENSPAGIGLLRTICQHKLGRGPVANCPSIIDSLCNIARSSDDWQYMAIDCLLWLLQDQNTCHKVIDKIVPALIDLAEITTLGDHKKLGETIVSVLHECSQSLGSTRNPLSSRTKELIDELLSSKQRSKREKNMPKEDLHIKQAASLVIKLEGNSLFSSGNIAAAASKYSEALALCPLRSKKERVVLYSNRAQCYLLLQQPLAAISDATRALCLHNPLNRHAKSLWRRAQAYDMLGLAKESLLDAILFINECSQSTDPDLSLRQNKVPDYAERLVKKQMRAAWLFREAAVKHGGVHCEGDNGEIYGQEGDDSEWETASESDIENDGRRDMGDDDEDDDDDDDDDSEWKMMMRGKTSMRSP

SEQ ID NO: 6953 - protein, 631 aa, Fragaria vesca
MDKASSECPYPGCFFCVMKEGNPSKRRASILKFFRDLPTQDDNGQVLPISGLWNTAMAHPNDPEFIELGIFECMASLIWKGLKNRRWLSHDQNIYIPYYAAHIIGSYTMNMEEFAESSVHAGVIAPLVELLRGRLTWVEQRVAVRALGHLATYASTFPAVASHGEILELSIQLGMSSLEIVYSHFYQYVDRRLSYHCDLLTRGMGGVEMESRKAEEWASQLQCWSLQLINCFAFKPEFLPTICKTEFLTKLPGMWGGLVNENSPAGIGLLRTICHHKLGRGPVASCPGIIEALCNIARSSDDWQYMAIDCLLWLLQDPSTCHKVIDKAVPALVDLAEITTLGDNKKLGDSIVNVLQECIQSQGTGRNSFSSRTKEMIEELLNSRQRLKWEKNMPKEDLHIKQAAALVVKLEGNSLFSSGNISGAASKYSEALTLCPMRSKKERVVLYSNRAQCFLLLQQPLAAISDATRALCLHSPLNRHAKSLWRRAQAYDMLGFAKESLLDAILFINECSQSNDPDLSLRQNKVPDYAERLVKKQMRAAWLFREAAIKHGGVHCEGDAGDIYGRESDDSEWETASESDIGNDGRDAMGNDDDDDDSEWKNEDERKDKYDKSSVKDLKHGYNVQLAEDEP

SEQ ID NO: 6954 - protein, 630 aa, Populus trichocarpa
MDKVSPDCPYPGCFFCVMKEGNPSKRRASILKFFRELPSQDDDGQVLPISGLWNTAMAHPNDPEFIELGIFECMAALIWKGLKNRRWLSHDQNVYIPYYAAHIIGSYTMNMEEFAESAVHAGVIAPLVELLRGRLTWVEQRVAVRALGHLATYTSTFPAVASHGEILELSIQLAISSLEIVYSHFYQYVDRRISYHCDLLTRGMGGVEMESRKAEEWASQLQCWSLQLINCFAFKPEFLPTICKPEFLVKLPGMWGGLVNENSPAGIGLLRTICHHKLGRGPVASCPGIIEALCNIARSSDDWQYMAIDCLLWLIQDPSTCHKVIDKAVPALVDLAEITNLGDHKKLGDTIVNVLQECLQSQGTGRNTISNRERELIEELLDSKQRLKWEKNMPKEDLHIKQAAALVVKLEGNSLFSSGNIAGAASKYSEALSLCPMRSKKERVVLYSNRAQCYLLLQQPLAAISDATHAVCLHNPPNCHAKSLWRRAQAYDMLGLAKESLLDAILFINECSQTNDPDLSLRQNKVPDYAERLVKKQMRAAWLFREAAIKHGGVHGEGDVGDIYGQESDGSEWETASESDMGNDGRVEMGDDDDDDSEWKNEDGRKDKYDKTTLKDIKHGYNLHLAEDES

SEQ ID NO: 6955 - protein, 635 aa, Manihot esculenta
MDKVSPDCPYPGCFFCVMKEGNPSKRRASILKFFRELPSQDDDGQVLPISGLWNTAMAHPNDPEFIELGIFECMAALTWKGLKNRRWLSHDQNIYIPYYAAHIIGSYTMNMEEFAESAVHAGVIPPLVELLRGRLTWVEQRVAVRALGHLATYASTFPSVSSHGEILELSIQLAMSSLEIVYSHFYQYVDRRLSYHCDLLTRGMGGVEMESRKAEEWASQLQCWSLQLINCFAFKPEFLPTICKPEFLVKLPGMWGGLVNENSPAGIGLLRTICHHKLGRGPVASCPGIIEALCNIARSSDDWQYMAIDCLLWLLQDPNTCHKVIDKAVPVLVDLAEITTLGDQKKLGDSIVNVLQDCIQSQGTGRTSVSSRTKEPIEELLNSKQRMKWEKNMPKEDLHIKQAAALVVKLEGNSLFSSGNISGAASKYSEALSLCPMRSKKERVVLYSNRAQCHLLLQQPLAAISDATRALCLHNPLNRHAKSLWRRAQAYDMLGLAKESLLDAILFINECSQSNDPDLCSRQNKVPDYAERLVKKQMRAAWLFREAAIKHGGVHCEGDARDVYGQDSDGSEWETASESDIGNDGRDEMGDDDDDIEWKNEDERKDKYDKATLKDIKQGYSVQIPEMNRNLEGTT

SEQ ID NO: 6956 - protein, 627 aa, Solanum phureja
MDKASADCPYPGCFFCVMKEGNPSKRRASILKFFRELPSQDDDGQVLPISGLWNTAMAHPNDPEFIELGIFECMSALIWKGLKNRRWLSHDQNIYIPYYAAHIIGSYTMNMEEFADRAVRAGIIPPLVELLRGRLTWVEQRVAVRALGHLATYASTFPAVASHGEILELSIQLAMSSLEIVYSHFYQYVDRRLSYHCDLLTRGMGGVEMESRKAEEWASQLQCWSLQLINCFAFKPEFLPTICKPEFLAKLPGMWGGLVNENSPAGIGLLRTICHHKLGRGPVAACPGIIEALCNIARSSDDWQYMAIDCLLWLLQDPSTCHKVIEKAVPALVDLAEISSLGDHKKLGDSIVNVLQECIESQGTGRTQINSHVKEEVEELLNSKQRLKWEKNMPKEDLHIKQAAALVVKLEGNSLFSSGNISGAAAKYSEALALCPMRSKKERVVLYSNRAQCHLLLQQPLAAIGDATRALCLHNPVNRHAKSLWRRAQAYDMLGLAKESLLDAILFINECSQSNDPDLSLRQNKVPDYAERLVKKQMRAAWLFREAAIKHGGVQCEGDAGDMCGQETDDSEWETASESEIGNEERDEIGNDICGWENEVERKDKYKKASLKEIKHGYNVQLTEDNV

SEQ ID NO: 6957 - protein, 627 aa, Solanum lycopersicum
MDKASADCPYPGCFFCVMKEGNPSKRRASILKFFRELPSQDDDGQVLPISGLWNTAMAHPNDPEFIELGIFECMSALIWKGLKNRRWLSHDQNIYIPYYAAHIIGSYTMNMEEFADRAVRAGIIPPLVELLRGRLTWVEQRVAVRALGHLATYASTFPAVASHGEILELSIQLAMSSLEIVYSHFYQYVDRRLSYHCDLLTRGMGGVEMESRKAEEWASQLQCWSLQLINCFAFKPEFLPTICKPEFLAKLPGMWGGLVNENSPAGIGLLRTICHHKLGRGPVAACPGIIEALCNIARSSDDWQYMAIDCLLWLLQDPSTCHKVIEKAVPALVDLAGISSLGDHKKLGDSIVNVLQECIESQGTGRTQINSHVKEEVEELLNSKQRLKWEKNMPKEDLHIKQAAALVVKLEGNSLFSSGNISGAAAKYSEALALCPMRSKKERVVLYSNRAQCHLLLQQPLAAIGDATRALCLHNPVNRHAKSLWRRAQAYDMLGLAKESLLDAILFINECSQSNDPDLSLRQNKVPDYAERLVKKQMRAAWLFREAAIKHGGVQCEGDAGDMCGQETDDSEWETASESEIGNEERDEIGDDICGWENEVERKDKYKKASLKEVKHGYNVQLTEDNV

SEQ ID NO: 6958 - protein, 616 aa, Aquilegia formosa
MDKMSQECPYPGCFFCVMKEGNPSKRRQSILKFFRELPSQDEDGQVLPISGLWNTAMAHPNDHEFIDLGIFECMAALIWKGLKNRRWLAHDQNIYIPYYAAHIIGSYTMNMEEFAESAVHAGVIPPLVELLRGRLTWVEQRVAVRAIGHLATYASTFPAVASHGEVLELSIELAMSSLEIVYSHFYQYVDRRLSYHCDLLTRGMGGVEMESRKAEEWASQLQCWSLQLINCFAFKPEFLSVICKPEFLVKLPGMWGGLVNENSPAGTGLLRTICHHKVGRVPVANCPTVVEALCNIARSSDDWQYMAIDCLLWLLQDPNTCQKVIDKAVPALIDLAEISTLGDHKKLGDTIVNVLQECIESQGTGRSSLSNRIIEQTEELLNCRQRLKWEKSMPKEDLHIKQAAALVVKLEGNSLFSSGNISGAASKYSEAITLCPVRSKKERVVLYSNRAQCHLLLQQPLAAISDATRALCLHNPVNRHAKSLWRRAQAYDMLGLAKESLLDAILFINECSQSNDPDLSLRQNKVPDYAERLVKKQMRAAWLFREAAIKHGGVHCDGEAGDIYGQEADDSEWETASESDIGNDGRGEMLDDDSEWKIDDERNKYEKPSLKGIGRH

SEQ ID NO: 6959 - protein, 615 aa, Citrus clementina
MEKVSPDCPYPGCFFCVMKEGNPSKRRASILKFFRELPSQDDDGQVLPISGLWNTAMAHPNDPEFIELGIFECMAALIWKGLKNRRWLSHDQNIYIPYYAAHIIGSYTMNMEEFAESAVHAGVIPPLVELLRGRLTWVEQRVAVRALGHLATYPSTFPTVASHAEILELSIQLAMSSLEIVYSHFYQYFDRRLSYHCDLLTRGMGGVEMESRKAEEWASQLQCWSLQLINCFAFKPEFLPAICKPEFLAKLPGMWGGLVNENSPAGIGLLRTICHHKLGRGPVASCPGLIEALCNIARSSDDWQYMAIDCLLWLLQDPSTCHKVIDKAVPTLIDLAEITNLGDHKKLGDSIVNVLQDCIQLQGTVRSSPSNRSKEQIEELLNSRQRLKWEKNMLKEDLHIKQAAALVVKLEGNSLFSAGNISGAASKYSEALALCPMRSKKERVVLYSNRAQCHLLMQQPLAAISDATRALCLHNPLNRHAKSLWRRAQAYDMLALAKESLLDAILFINECSQSNDPDLSLRQNKVPDYAERLVKKQMRAAWLFREAAIKHGGVHGEGNSGNIYGHETDDSEWETASESDIGNDGRDEMGDEDDDSEWKNEDERKDKYDKPPMKA

SEQ ID NO: 6960 - protein, 634 aa, Euphorbia peplus
MDKASPDCPYPGCFFCVMKEGNPSKRRASILKFFRELPSQDDDGQVLPISGLWNTAMAHPNDPEFIELGIFECMAALIWKGLKNRRWLSHDQNIYIPYYAAHIIGSYTMNMEEFAETAVHAGVIPPLVELLRGRLTWVEQRVAVRALGHLATYASTFPAVASQGEILELSIQLAMSSLEIVYSHFYQYVDRRLSYHCDLLTRGMGGVEMESRKAEEWASQLQCWSLQLINCFAFKPEFLPSICKAEFLVKLAGMWGGLVNENSPAGIGLLRTICHHKLGRGPVASCPGIVEALCNIARSSDDWQYMAIDCLLWLLQDPNTCHKVIDKAVPALIDLAEISALGDHKKLGDSIVSVLHDCIQSQGTGRSSISNKTKEMVEELLNAKQRLKWEKNMPKEDLHIKQAAALVVKLEGNSLFSSGNISGAASKYSEALSLCPMRSKKERVVLYSNRAQCHLLLQQPLAAISDATRALCLHNPLNRHAKSLWRRAQAYDMLGLAKESLLDAILFINECSQSNDPDLCLRQNKVPDYAERLVKKQMRAAWLFREAAIKHGGVHGEADAAGDMYGQDTDGSEWETASESDIGNDGRDEMGDDDEEEDDDGEWKNEDERKDKYDKHSLKDIKRGYNVQLAEDES

SEQ ID NO: 6961 - protein, 614 aa, Cucumis sativus
MEKVSTDCPYPGCFFCVMKEGNPSKRRASILKFFRELPSQDDDGQVLPISGLWNTAMAHPNDPEFIELGIFECMSALIWKGLKNRRWLSHDQNIYIPYYAAHIIGSYTMNMEEFAETAVHAAVIPPLVELLSGRLTWVEQRVAVRALGHLATYASTFPAVASHAEILELSIQLAMSSLEIVYTHFYQYVDRRLSYHCDLLTRGMGGVEMESRKAEEWASQLQCWSLQLINCFAFKPEFLPTICKPEFLVKLPGMWGGLVNENSPAGIGLLRTICHHKLGRGPVANCPSIIEALCNIARSSDDWQSMAIDCLMWLLQDPNTSHKVIDKAAPTLLDLAEISSLGDHRKLGESITNVLQECIQSQGAGRNSISNRTKEQIEELLKSRQRLKWEKSMPKEDLRIKQAAALVIKLEGNSMFSSGNISAAASKYSEALALCPMRSKKERVVLYSNRAQCYLLLQQPIAAIGDATRALCLHNPVNRHAKSLWRRAQAYDMLGLAKESLLDAILFINECSQSNDPDLSLRQNKVPDYAERLVKKQMRAAWLFREAAIKHGNVQCEDGAGDVYGRETDDSEWETASESDIGNDGRDEMGEEEEDDEDCDWKDEDKYDKSSIKG

SEQ ID NO: 6962 - protein, 622 aa, Citrullus lanatus
MEKVSTDCPYPGCFFCVMKEGNPSKRRASILKFFRELPSQDDDGQVLPISGLWNTAMAHPNDPEFIELGIFECMSALIWKGLKNRRWLSHDQNIYIPYYAAHIIGSYTMNMEEFAESAVHAGVIAPLVELLRGRLTWVEQRVAVRALGHLATYASTFPAVASHAEILELSIQLAMSSLEIVYTHFYQYVDRRLSYHCDLLTRGMGGVEMESRKAEEWASQLQCWSLQLINCFAFKPEFLPTICKPEFLVKLPGMWGGLVNENSPAGIGLLRTICHHKLGRGPVASCPSIIEALCNIARSSDDWQSMAIDCLMWLLQDPNTSHKVIDKAAPTLLDLAEISSLGDHRKLGESIINVLQECVQSQGAGRNSISNRTKEQIEELLKSRQRLKWEKNMPKEDLRIKQAAALVIKLEGNSMFSSGNISAAASKYSEALALCPMRSKKERVVLYSNRAQCYLLLQQPLAAIGDATRALCLHNPVNRHAKSLWRRAQAYDMLGLAKESLLDAILFINECSQSNDPDLSLRQNKVPDYAERLVKKQMRAAWLFREAAIKHGNVQCEDGAGDIYGRETDDSEWETASESDIGNDGRDEMGDEEDDDEDCDWKDEDKYDKSSIKGTFELIYSG

SEQ ID NO: 6963 - protein, 233 aa, Setaria italica
MGSSGGSSEHFLRQLSSSDGGGSAPHQLLQQEWECGGGSRRGSRRWSRKKARARGHRRGGGFCRTEEAAAAGRKRVMVVVDQSSGAKHAMMWALTHVASKGDFLTLLHVLPPQTGNGGGGGRGGGVDASALANSLGALCKACKPEVEVEALVIQGPKLSTVLSQVKKLEASVLVLSQRKPSPFCCFMRSGSEAFVEECINRAECLTLAVRRQSKGVGGYLVSTRWQKNFWLLA

SEQ ID NO: 6964 - protein, 238 aa, Zea mays
MGSSGGSCEHFLGQLSSSDGGSAPHQLLQREWDCGTGTGSRRGSRRWSRKKGRARGHRRGGGFCRTEEAAAASRKRVVVVVDQSSGAKHAMMWALTHVANRGDFLTLLHVLPPHSGSGGGGRGAGEEDASALANSLGALCKACKPEVEVEALVIQGPKLSTILSQVKKLEASVLVLSQRKPSPFCCFLRSRSSSEEEELVEECINRAECLTLAVRRRSKGVGGYLVSTRWQKNFWLLA

SEQ ID NO: 6965 - protein, 242 aa, Sorghum bicolor
MGSSGGSSEHFLRQLSSSDGGGSAPHQLVQREWECGGGGTGSRRGSRRWSRTKKASRARGHRRFCRTEEAAAAAAAGRKRVMVVVDQSSGAKHAMMWALTHVANKGDFLTLLHVLPPQSGSGIGTSVGGGRGVAEDASALANSLGALCKACKPEVEVEALVIQGPKLSTILSQVKKLEASVLVLSQRKPSPFCCFLRSSSEEVVEECINRAECLTLAVRRQSKGVGGYLVSTRWQKNFWLLA

SEQ ID NO: 6966 - protein, 230 aa, Secale cereale
MGSSGGSSDYFLRQLSSSDGGSAPAPAPRQPEEWECGAGTGTGRRGSRRWSRKKARARGHRRGGFCGAPEEAAVAGRKRVMVVVDQSSGAKHAMMWALTHVANRGDFLTLLHVLPRGGAGRGEDASALANSLGSLCKACKPEVEVEALVIQGPMLATVLSQVKKLEASVLVLSQSKPSPFCCFMRSRGEVLVEECISRAECLTLAVRRQSKGVGGYLVSTRWQKNFWLLA

SEQ ID NO: 6967 - protein, 228 aa, Triticum aestivum
MGSSGGSSDYFLRQLSSSDGGSAPAPAPRQPGEWECGGGRRGSRRWSRKKARARGHRRGGGGFCGAPEEAAAAGRKRVMVVVDQSSGAKHAMMWALTHVANRGDFLTLLHVLPRGGGARGDDAAALANSLGSLCKACKPEVEVEALVIQGPMLATVLSQVKKLEASVLVLSQSKPSPFCCFMRSRGEVLVEECISRAECLTLAVRRQSKGVGGYLVSTRWQKNFWLLA

SEQ ID NO: 6968 - protein, 253 aa, Secale cereale
MGSSGGSSDYFLRQLSSSDGGSAPAPAPRQPEEWECGAGTGTGRRGSRRWSRKKARARGHRRGGFCGAPEEAAVVGRKRVMVVVDQSSGAKHAMMWALTHVANRGGLPHAAPRPAARRRRPRRGRLRARQLPRLPLQGLQARGGGGGACDPGAHAGHRPEPGEEAGGVRARAQPKQAVPFLLLHAEPRRGAGGGVHQQGGVPDAGGAAAERRASAATSSAPGGRRTSGSWLDVRSLTTRASLDDFIADREANK

SEQ ID NO: 6969 - protein, 134 aa, Zea mays
MAAYAGILVPPLPVRLSVSHLRSVTPASYSLNHRPPRPAVARAASRGNGNGGPPVEGEKERRRSSLPALSEIRLGELLSPDPANAVAVVLTGALVWAGASLLLQLTLISAAIFAAAVKYSFVAALLLIVLIALL

SEQ ID NO: 6970 - protein, 137 aa, Sorghum bicolor
MAAHAGTLVPHHLPVRLAVAHPRPVTHPSCSLLRPRLPRLAVARAASRGGNGDGGPPAEGEKERRAPSFPALSEIRWGELLSPDPANAAAVVLTGALAWAGASLLLQIALISAAIFAAAIKYSFVAALLLFVLIALL

SEQ ID NO: 6971 - protein, 1113 aa, Sorghum bicolor
MRPLALVALLLASVLGSRGTTLAPSPAVTDSPANQGQASSPPQPAFALGPVTVPTGPATPSASPSPEKAAVSPASPVEPQNAPSPVTSPKENNAPPPIEVAPPDPTDEVPPPVAPPQAAAGNPTPILPGTPALLPSVQAPAPSVVLKPSPPVAPPQAAVGNPTPILPGTPALLPSVQAPAPSVVLKANPPVASPPSASNQPSRPVGSVPPYRPPVLPPPANDVPPYPPSGSFPAIPPSTSDPPPTASPVIAQAPQRQADPRSRDYKNGNTAPSANTYPPTSLKKHHVPHASPPKESTGQTAPVHKSPVTGSAPATSPLPQNTNMPSIPKNASSVSHAQPSPPSVAPKLAPTGRSHARGWKSRNPNNGTNRSSAPSYPPPRAQGPEVSRAPRQTGTKSHTHHAPPPIPQGHPSLPVHSPSPSPASSRSPANGKKSHRISPTLPPIPPLPEPKAPSAHPIWTLPPPPPNSDCNSLSCPEPLTDPPAGAPCACVLPIRVGIRLSVDLYSFFPLVSDFAEEVASGVNMAQSQVRVMGANVAGDQPDKTMVLVDLVPMQVKFDNATAFSAFESLWGKKVSLKPSVFGNYAILYVVYPGLPPSPPSGPEGVGDGAFGNNGNARAMKPLGVDVGRPKRKVNGSLIAVAVLSTVIALIICCLAAWLLILRFRGPSDTAQGFPRTVLPKFSRSSGTGHTLLVGAGRYSSPSGPSGSLGSSIATYAGQAKTFKFAEIDKATNGFDDSKVLGEGGFGCVYQGTLEDGTTVAVKVLKRYDGQGEREFLAEVEMLGRLHHRNLVKLLGICIEENARCLVYELIPNGSVESHLHGVDRETAPLDWNSRMKIALGAARALAYLHEDSSPCVIHRDFKSSNILLEDDYTPKVSDFGLARTARGEGNQHISTRVMGTFGYVAPEYAMTGHLLVKSDVYSYGVVLLELLTGRKPVDMSQPAGQENLVAWARPLLTNVLSLRQAVDPLLGPNVPLDNVAKAAAIASMCVQPEVAHRPSMGEVVQALKLVCSEGDDCLASGRFSQELPMQSRAIYDATGMEAERVLISEIYGSTPVFTPAADSDSFRKQSSSGPLMTGKNRKFWQRLRSLSRGSMSEHGVSPDYETRSQYSGR

SEQ ID NO: 6972 - protein, 1076 aa, Setaria italica
MRTLALVALLLASALGSRGTTLAPSPAVTDSPPDQGQASSPPEPAFALGPVTIPTAPSTPSASPSPEKAAVSPAAPTEPQNAPSPITPPEVYNAPPPIEVAPTDPTDEVPAPVAPPQAAAENPTPILPGAPALLPSVQAPAPSVALKPIPPVVPPPSVNNQPNRPVGSVPPHPPPALPPPANDVPPYPPSGSFPAIPPSASVPHVNPPIASPVVQAPRQQAEAPRSEHKNGNTAPPANISPPANLKKHHVPHASPPKESTGQTVPDHKPPVTGSAPATSPSPQNTNMPSIPKNASSVSHAQPSPPSLAPKSAPTGRSHARGWKSNTPKNGGNPSIAPSFPPSRAQGPEVSRAPRQTGTKRQNHHAPPPIPQGHPSFPVHPPSPSPASSRGPTKGKKRHHLSPTLPPIPPLPEPKAPSAHPIWTLPPPPPNSDCNSLSCPEPLTDPPAGAPCACVLPIRVGIRLSVDLYSFFPLVSDFAEEVSSGVNMAERQVRVMGANVAGDQPDKTMVLVDLVPMQVKFDNATAFSAFESLWSKKISLKPSVFGDYEILYVVYPGLPPSPPSAPEGVGDGAFGNNRNARAMKPLGVDVRRPKRKVNGSLIAIAVLSTVIALIICCLAAWLLILRFRGPSDTAQGFPHNVLPKFSRSSGTGHTHLAGVGRYSSPSGPSGSLGSSIATYAGQAKTFKFAEIDKATNGFDDSKVLGEGGFGCVYQGTLEDGTTVAVKVLKRYDGQGEREFLAEVEMLGRLHHRNLVKLLGICVEENARCLIYELIPNGSVESHLHGVDRETAPLDWNSRMKIALGAARALAYLHEDSSPCVIHRDFKSSNILLEHDFTPKVSDFGLARTARGEGNQHISTRVMGTFGYVAPEYAMTGHLLVKSDVYSYGVVLLELLTGRKPVDMSQPAGQENLVAWARPLLTNVLSLRQAVDPLLGPNVPLDNVAKAAAIASMCVQPEVAHRPSMGEVVQALKLVCSEGDDCLASGRFSQELPIHTTAVYDVTGMEAERVLISEIFGSTPVFTPADDSGSFRKQSSSGPLMTGKNRKFWQRLRSLSRGSMSEHGVSPDYETRSQYSGR

SEQ ID NO: 6973 - protein, 78 aa, Unknown
  Sequence found in Organisms: Sorghum bicolor, Triticum aestivum
MASLLSLYGSGGRRRMSRSSGTAAPVRRLLRRLRSSFGRSAARPRRRSAVRFGYDLHSYSQNFDDGVASSAPAAMACA

SEQ ID NO: 6974 - protein, 389 aa, Sorghum bicolor
MASSSCVRLHHLPSTSRRATAPTNLQFRAASCRWRRLSIPVPGVSPPPLRLRATGASQPLGTDSNEEVEKVEEQPQPPPRLKIAVVGFGTFGQFLARTLVAQGHTVLAHSRSDHSAAAASMGALFFSDPHDLCECHPDVVLLATSILSAESVVRSLPLHRLRRDTLFADVLSVKEFPKRLLLGLLPEEMDILCTHPMFGPESARAGWAGLPFMFDKVRVRDTVPARRARAEAFLDVFAQEGCRMVEMSCAEHDAHAAETQFLTHTVGRMLAALELRATPIDTRGYETLLRLVENTCSDSFDLYNGLFMYNNNSTELLNRLDWAMDAVKRRLFDGLHDVLRRQLFHVGEVEGEAERMEELAVVPGGGPDTDDDGCATATATSIKSGEENN

SEQ ID NO: 6975 - protein, 976 aa, Setaria italica
MTDMRRHSVDVPLSRTLVQLKRVRSLRDPATNSLSKYASPSDHMIWETASSNGVTLELGRSVHHQLVEEDEDLGAEATMGSERSFRAPNARTASYRKTSAVKIRGLNPPRNKQVHRVRQDGHRKSLDSNHSNHSSIRQLANNIVNNVDAEKEEEEVNSYERPNFALPDKDDEEVKMPGYPNFRTKSSAAMSRVGSPCMSASEARSVASRRSTLGHGTEDTRLRSNDVVGSNFSGCGISYCWSGASKYRELYSDSDGPEQPLLSTDGTEAAFQSNVPYTETPRCLSQKFRPRSFSELIGLNVVAQSLLYSSCKGKVAPMYLFHGPRGTGKTSTARIFAAALNCVSLEEQRPCGFCKECVILFSGKSRDVKELDAAKMDRLGRVKALLKSASLVPYSSRFKVFIIDECHLLQEDAWSAILKSLDEPYRHTVYIMITSDIESLPRTSITHCQKFHFPKIKVADIVYRLERICIEEGLEFDHDGLYFIAAKSNGSLRDSEIMLDQLSLLGKKITISLVHELVGSVSDDELIELLDLALSSDTTNTVRRARELMGSAIDPLQLVSQLANLIMDILSGRCQSAVTEVSKSFLGRYALSEVGIKKLRHALKILSETEKQLRTSRNQATWVTVALLQFGTTESNLVAEPNDMHAHSVTGYTDDWVSKVHSSSNFCQACNSNKSNCSERHCRRLKLENIWRRAIGKCRSRSAKSFLRKEGFLSSVHVTEELAIAEVGFGHPDHLSRAEKMQSLIECALQHVLGCNVEIRFKLVSCPVRKDARLKRQSFSFLNCSGRKQELSDSVVTDEDEAVRPGARETPLKGYTSSQKESPYVMQRVDSKPTVHGCEDDARSTLTSNRSVTDDLTRTCRSETNYSKGVSEQGRFDSIQEPDLQPNCFSRTLKLQKKLLSSGAAHTICLRIQPHNKMDFLPKKEFDTYFCAYEPYEQCSRSTSRATYSSRDDDLWSKNSRFGSNLLCWRAPKQSM

SEQ ID NO: 6976 - protein, 970 aa, Oryza sativa
MADMRRHSVDVPLSRTLVQLKRVRSLRDPATNSLSKYASPSDNMIWETASSNGVAMDLGRSAHHQLIEEDGDLEAEATLGSERSFRAPNARTASYRKSSVVKIRGLNPPRNKQAHRARQDGHRKSVDSSHSNHSSIRQLANTMVNNVAEEKEEEEEVNSYERSVPTPPAKTDEEVKMPGFSKFRNKSSAAMSRVGSPCMSASEARSVRSRRTEETQVRSNDVVGSNFSGCGISYCWSGASKYRELYYDSDGPEQPLLSPEGTDAAFQENVPYTETPRCLSQKFRPRSFSELIGLNVVAQSLLYSSCKGKVAPMYLFHGPRGTGKTSTARIFAAALNCLSLEEQRPCGFCKECVILFSGRSRDVKELDAAKMDRLGRVKALLKSASLVPYSSRFKVFIVDECHLLPEDAWSAILKSLDEPYRHAVYIMITSDIDSLPRTSITHCQKFHFPKIKVADIVYRLERICIEEGLEFDHDGLYFISAKSNGSLRDAEIMLDQLSLLGKKITISLVHELVGSVSDDELIELLDLALSSDTTNTVRRARELMASAIDPLQLVSQLANLIMDILSGRCQSAVTEVSKSFLGRYALAEVGIKKLRHALKILSETEKQLRTSRNQATWVTVALLQFGTNESNLIAESNDMHAHSAIGYTDDWVSKVNSSSNFCHACNSNKSNCSERHCRRLKLENIWRRAIGKCQSRSAKNFLRKEGFLSSVHVTEELAIAEVGFSHPDHISRAEKMQSLIESTLQNVLGCNVEVKFKLVPRPVRKDARSKRQSFSLLSCSGRKQELSDSAVTDEDETVRHGARETPSKGYSSQQQSPFIMQRTDSKPTVHGCEDDARSTLTSNRSMTDDMTRTCRSETNYSKGVSEQGRFDSIQEPDLQPNCFSRTLKLQKRFFSSDAAHTICLKIQPHNKMDFLPKKEFDTYFCAYEPYEQCSRSNSHATCSSRDDNLWNKNSRFGSHLLCWRGPKQAI

SEQ ID NO: 6977 - protein, 977 aa, Brachypodium distachyon
MTDMRRHSVDVPLSRTLVQLKRVRSLRDPATNSLSRYASASDNMIWETASSNGVPIELSRSTHHQLIEEDGDFEAEAAMGSERSLRAPNARTTSYRKSSVVKIRGLNPPRNKQVHRVRGDGHRKSVDSNHSNNSSLRQLANNVVNNMEEKKEEEEEVNSYERADVLLPEKTDEEVKMPGQSKFRDKSSAAMSRVGSPCMSASEARSVGSRRSTLGHGTEDTRVRSNDVVGSNFSGCGISYCWSGASKYRDLYSDSDGPEQPLLSTEGTEVAFQDNAPYTETPRCLSQKFRPRSFSELIGLNVVAQSLLYSSCKGKVAPMYLFHGPRGTGKTSTARIFAAALNCLSLEEQRPCGFCKECVILFSGRSRDVKELDAAKLDRLGRVKALLKSASLVPYSSRFKVFIVDECHLLQEDAWSAIMKSLDEPYRHTVYIMITSDLDSLPRASITHCQKFHFPKIKVADIVYRLERICIEEGLEFDHDGLYFIAAKSNGSLRDSEIMLDQLSLLGKRVTVSLVHELVGLVSDDELIELLDLALSSDTTNTVRRARELMASSIDPLQLVSQLANLIMDILSGRCQSAVTEVSKSFLERYALAEVGIQKLRHALKILSETEKQLRTSRNKATWVTVALLQFGTNECNIVADTNDMNAHSATGYTDDWVSKVNSSSNFCDACNSNKSNCSERYCRRLKLENIWRRAIGKCQSRSAKSFLKKEGILSSVHVTEELAIAEVGFSHPDHLSRAEKMQSLIESMLQHVLGFNVEIKFKIVPRAARKDGRLKRHSFSLLSCSGRKQELSDSTVTDEDETVRHGARETPLKGYSSSQQQSPFIVQRVDSKPRVHGCEDDARSTLTSNRSMTDDQTRTCRSETNYSKGASEQGRFDSIQEPDLQPNCFSRTLKLQKRFFSSDAAHTICFRIQPHNKMGFLPKKEFDTYFCAYEPYEQCPRSNSRATYGSRDEDLSIKSSRFGSNLLCWRGPKQSI

SEQ ID NO: 6978 - protein, 191 aa, Sorghum bicolor
MFPRISRLGARLLRESRAETRAGNLLSSRGILYQGHVNRHSTPVMTPTVLSLRNVLLSTATSGEQDESSQPKDKISVTFVNKDGSEKTISVPVGMSMLEAAHENDIELEGACEGSLACSTCHVIVMDVNYYNKLEDPADEENDMLDLAFGLTETSRLGCQVIAKPELDGMRLALPVATRNFAVDGYVPKPH

SEQ ID NO: 6979 - protein, 189 aa, Setaria italica
MFSRISRLGARLLREARAETRAGNLLSSRGSLYQGHVSQHSTPLVTPTVKSMSNVLFSTATSGDQDESNQEKISVTFVNKDGSEKTIRVPVGMSMLEAAHENDIELEGACEGSLACSTCHVIVMDVNHYNKLEDPTDEENDMLDLAFGLTETSRLGCQVIARPELDGMRLALPAATRNFAVDGYVPKPH

SEQ ID NO: 6980 - protein, 191 aa, Panicum virgatum
  misc_feature (3)..(3): Xaa can be any naturally occurring amino acid
  misc_feature (10)..(10): Xaa can be any naturally occurring amino acid
  misc_feature (35)..(35): Xaa can be any naturally occurring amino acid
  misc_feature (38)..(38): Xaa can be any naturally occurring amino acid
  misc_feature (42)..(42): Xaa can be any naturally occurring amino acid
  misc_feature (46)..(46): Xaa can be any naturally occurring amino acid
MFXRISRLGXRLLREGRAETRAGNLLSSRGSLYQXHVXQHSXPVVXPTLQSLRNVLFSTATSGDQDGSGQEKEKISVTFVNKDGSEKTISVPIGMSMLEAAHENDIELEGACEGSLACSTCHVIVMDVNDYNKLEEPTDEENDMLDLAFGLTETSRLGCQVIAKPELDGMRLALPAATRNFAVDGYVPKPH

SEQ ID NO: 6981 - protein, 189 aa, Pennisetum glaucum
MFSRIPRLGSRLLREARAETGAGNLLSSRGSLYQGHVNRYPTPLVTPTVKSMRNVLFSTATSGHQNESNQEKISVTFVNKDGSEKTISVPVGMSMLEAAHENDIELEGACEGSLACSTCHVIVMDVNHYNKLEDPTDEENDMLDLAFGLTETSRLGCQVIAKPELDGMRLALPAATRNFAVDGYVPKPH

SEQ ID NO: 6982 - protein, 179 aa, Setaria italica
RLLREARAETRAGNLLSSRGSLYQGHVSQHSTPLVTPTVKSMSNVLFSTATSGDQDESNQEKISVTFVNKDGSEKTIRVPVGMSMLEAAHENDIELEGACEGSLACSTCHVIVMDVNHYNKLEDPTDEENDMLDLAFGLTETSRLGCQVIARPELDGMRLALPAATRNFAVDGYVPKPH

SEQ ID NO: 6983 - protein, 269 aa, Zea mays
MLRNGNEGMSTIPGFSQIQFEGFCRFINQGLAEELEKFPTIKDPDHEIAFQLFAKGYQLLEPSIKERNAVYESLTYSSELYVSARLIFGFDVQKETISIGNIPIMNSLGTFIINGIYRIVINQILLSPGIYYRSELDHKGISIYTGTIISDWGGRSELAIDKKERIWARVSRKQKISILVLSSAMGSNLREILDNVSYPEIFLSFPNAKEKKRIESKEKAILEFYQQFACVGGDLVFSESLCEELQKKFFSTKNVNLGRSWSTKYESEN

SEQ ID NO: 6984 - protein, 311 aa, Brassica rapa
MLRNGNEGMSTIPGFSQIQFEGFCRFINQALAEELDKFPTIKDPDHEIAFQLFAKGYQLLEPSIKERDAVYESLTYSSELYVSARLIFGFDVQKQTISIGNIPIMNSLGTFIINGIYRIVINQILLSPGIYYRSELDHKGISIYTGTIISDWGGRSELAIDKKERIWARVSRKQKISILVLSSAMGSNLREILDNVSYPEIFLSFPNAKEKKRIESKEKAILEFYQQFACVGGDLVFSESLCEELQKKFFQQKCELGRIGRRNMNRRLNLDIPQNNTFLLPRDVLAATDHLIGMKFGTGILDDDDMNHLEK

SEQ ID NO: 6985 - protein, 481 aa, Setaria italica
MEMRECPQYPDLVRSNSRDFVDSLIRAWQKNLRSFQQLKIQITKLHFNYCERISIARTLDKERDAVYESLTYSSELYVSARLIFGFDVQKQTISIGNIPIMNSLGTFIINGIYRIVINQILLSPGIYYRSELDHKGISIYTGTIISDWGGRSELAIDKKERIWARVSRKQKISILVLSSAMGSNLREILDNVSYPEIFLSFPNAKEKKRIESKEKAILEFYQQFACVGGDLVFSESLCEELQKKFFQQKCELGRVGRRNMNRRLNLDIPQNNTFLLPRDVLAATDHLIGMKFGTGILDDDDMNHLKNKRIRSVADLLQDQFGLALGRLQHAVQKTIRRVFIRQSKPTPQTLVTPTSTSILLITTYETFFGTYPLSQVFDQTNPLTQTVHGRKVSCLGPGGLTGRTASFRSRDIHPSHYGRICPIDTSEGINVGLTGSLAIHARIDHWWGSIESPFYEISEKAKEKKRDRWFIYHQIEMNII

SEQ ID NO: 6986 - protein, 1075 aa, Oryza sativa
MLRNGNEGMSTIPGFSQIQFEGFCRFINQGLAEELEKFPTIKDPDHEISFQLFAKGYQLLEPSIKERDAVYESLTYSSELYVSARLIFGFDVQKQTISIGNIPIMNSLGTFIINGIYRIVINQILLSPGIYYRSELDHKGISIYTGTIISDWGGRSELAIDKKERIWARVSRKQKISILVLSSAMGSNLKEILDNVSYPEIFLSFPNAKEKKRIESKEKAILEFYQQFACVGGDLVFSESLCEELQKKFFQQKCELGRIGRRNMNRRLNLDIPQNSTFLLPRDVLAATDHLIGMKFETGILDDDDMNHLKNKRIRSVADLLQDQFGLALGRLQHAVQKTIRRVFIRQSKPTPQTLVTPTSTSILLITTYETFFGTYPLSQVFDQTNPLTQTVHGRKVSCLGPGGLTGRTASFRSRDIHPSHYGRICPIDTSEGINVGLTGSLAIHARIDHWWGSVESPFYEISEKAKKKKERQVVYLSPNRDEYYMIAAGNSLSLNRGIQEEQVVPARYRQEFLTIAWEQIHVRSIFPFQYFSIGGSLIPFIEHNDANRALMSSNMQRQAVPLSRSEKCIVGTGLERQTALDSRVSVIAEREGKIISTNSHKILLSSSGKTISIPLVTHRRSNKNTCMHQKPRVPRGKSIKKGQILAEGAATVGGELALGKNVLVAYMPWEGYNFEDAVLISERLVYEDIYTSFHIRKYEIQTDTTSQGSAEKITKEIPHLEEHLLRNLDRNGVVKLGSWVETGDILVGKLTPQIASESSYIAEAGLLRAIFGLEVSTSKETSLKLPIGGRGRVIDVKWIQRDPLDIMVRVYILQKREIKVGDKVAGRHGNKGIISKILPRQDMPYLQDGTPVDMVFNPLGVPSRMNVGQIFESSLGLAGDLLKKHYRIAPFDERYEQEASRKLVFSELYEASKQTKNPWVFEPEYPGKSRIFDGRTGDPFEQPVLIGKSYILKLIHQVDEKIHGRSTGPYSLVTQQPVRGRAKQGGQRIGEMEVWALEGFGVAHILQEILTYKSDHLIARQEILNATIWGKRVPNHEDPPESFRVLVRELRSLALELNHFLVSQKNFQVNREEV

SEQ ID NO: 6987 - protein, 1075 aa, Oryza sativa
MLRNGNEGMSTIPGFSQIQFEGFCRFINQGLAEELEKFPTIKDPDHEISFQLFAKGYQLLEPSIKERDAVYESLTYSSELYVSARLIFGFDVQKQTISIGNIPIMNSLGTFIINGIYRIVINQILLSPGIYYRSELDHKGISIYTGTIISDWGGRSELAIDKKERIWARVSRKQKISILVLLSAMGSNLKEILDNVSYPEIFLSFPNAKEKKRIESKEKAILEFYQQFACVGGDLVFSESLCEELQKKFFQQKCELGRIGRRNMNRRLNLDIPQNSTFLLPRDVLAATDHLIGMKFETGILDDDDMNHLKNKRIRSVADLLQDQFGLALGRLQHAVQKTIRRVFIRQSKPTPQTLVTPTSTSILLITTYETFFGTYPLSQVFDQTNPLTQTVHGRKVSCLGPGGLTGRTASFRSRDIHPSHYGRICPIDTSEGINVGLTGSLAIHARIDHWWGSVESPFYEISEKAKKKKERQVVYLSPNRDEYYMIAAGNSLSLNRGIQEEQVVPARYRQEFLTIAWEQIHVRSIFPFQYFSIGGSLIPFIEHNDANRALMSSNMQRQAVPLSRSEKCIVGTGLERQTALDSRVSVIAEREGKIISTNSHKILLSSSGKTISIPLVTHRRSNKNTCMHQKPRVPRGKSIKKGQILAEGAATVGGELALGKNVLVAYMPWEGYNFEDAVLISERLVYEDIYTSFHIRKYEIQTDTTSQGSAEKITKEIPHLEEHLLRNLDRNGVVKLGSWVETGDILVGKLTPQIASESSYIAEAGLLRAIFGLEVSTSKETSLKLPIGGRGRVIDVKWIQRDPLDIMVRVYILQKREIKVGDKVAGRHGNKGIISKILPRQDMPYLQDGTPVDMVFNPLGVPSRMNVGQIFESSLGLAGDLLKKHYRIAPFDERYEQEASRKLVFSELYEASKQTKNPWVFEPEYPGKSRIFDGRTGDPFEQPVLIGKSYILKLIHQVDEKIHGRSTGPYSLVTQQPVRGRAKQGGQRIGEMEVWALEGFGVAHILQEILTYKSDHLIARQEILNATIWGKRVPNHEDPPESFRVLVRELRSLALELNHFLVSQKNFQVNREEV

SEQ ID NO: 6988 - protein, 1075 aa, Oryza sativa
MLRNGNEGMSTIPGFSQIQFEGFCRFINQGLAEELEKFPTIKDPDHEISFQLFAKGYQLLEPSIKERDAVYESLTYSSELYVSARLIFGFDVQKQTISIGNIPIMNSLGTFIINGIYRIVINQILLSPGIYYRSELDHKGISIYTGTIISDWGGRSELAIDKKERIWARVSRKQKISILVLSSAMGSNLKEILDNVSYPEIFLSFPNAKEKKRIESKEKAILEFYQQFACVGGDLVFSESLCEELQKKFFQQKCELGRIGRRNMNRRLNLDIPQNSTFLLPRDVLAATDHLIGMKFETGILDDDDMNHLKNKRIRSVADLLQDQFGLALGRLQHAVQKTIRRVFIRQSKPTPQTLVTPTSTSILLITTYETFFGTYPLSQVFDQTNPLTQTVHGRKVSCLGPGGLTGRTASFRSRDIHPSHYGRICPIDTSEGINVGLTGSLAIHARIDHWWGSVESPFYEISEKAKKKKERQVVYLSPNRDEYYMIAAGNSLSLNRGIQEEQVVPARYRQEFLTIAWEQIHVRSIFPFQYFSIGGSLIPFIEHNDANRALMSSNMQRQAVPLSRSEKCIVGTGLERQTALDSRVSVIAEREGKIISTNSHKILLSSSGKTISIPLVTHRRSNKNTCMHQKPRVPRGKSIKKGQILAEGAATVGGELALGKNILVAYMPWEGYNFEDAVLISERLVYEDIYTSFHIRKYEIQTDTTSQGSAEKITKEIPHLEEHLLRNLDRNGVVKLGSWVETGDILVGKLTPQIASESSYIAEAGLLRAIFGLEVSTSKETSLKLPIGGRGRVIDVKWIQRDPLDIMVRVYILQKREIKVGDKVAGRHGNKGIISKILPRQDMPYLQDGTPVDMVFNPLGVPSRMNVGQIFESSLGLAGDLLKKHYRIAPFDERYEQEASRKLVFSELYEASKQTKNPWVFEPEYPGKSRIFDGRTGDPFEQPVLIGKSYILKLIHQVDEKIHGRSTGPYSLVTQQPVRGRAKQGGQRIGEMEVWALEGFGVAHILQEILTYKSDHLIARQEILNATIWGKRVPNHEDPPESFRVLVRELRSLALELNHFLVSQKNFQVNREEV

SEQ ID NO: 6989 - protein, 105 aa, Brachypodium distachyon
MNRRLNLDIPQNNTFLLPRDVLAATDQLIGMKFGTGILDDDDMNHLKNKRIRSVADLLQDQFGLALGRYNMRFKNYPSSIHTSIETDSPYFSNSNFNFDFINNYL

SEQ ID NO: 6990 - protein, 1040 aa, Brachypodium distachyon
CSGMGMRECPQYPDLVRSNLRDFVEPSIKERDAVYESLTYSSELYVSARLIFGFDVQKQTISIGNIPIMNSLGTFIINGIYRIVINQILLSPGIYYRSELDHKGISIYTGTIISDWGGRSELAIDKKERIWARVSRKQKISILVLSSAMGSNLREILDNVSYPEIFLSFPNAKEKKRIESKEKAILEFYQQFACVGGDLVFSESLCEELQKKFFQQKCELGRIGRRNMNRRLNLDIPQNNTFLLPRDVLAATDQLIGMKFGTGILDDDDMNHLKNKRIRSVADLLQDQFGLALGRLQHAVQKTIRRVFIRQSKPTPHTLVTPTSTSILLITTYETFFGAYPLSQVFDQTNPLTQTVHGRKVSCLGPGGLTGRTASFRSRDIHPSHYGRICPIDTSEGINVGLTGSLAIHAKIDHLWGSVESPFYEISAEKAKEKKERQVVYLSPNRDEYYMIAAGNSLSLNQGIQEEQVVPARYRQEFLTIVWEQIHVRSIFPFQYFSIGGSLIPFIEHNDANRALMSSNMQRQAVPLSRSEKCIVGTGLERQTALDSRVSVIAEREGKIISTDSHRILLSSSGKTISIPLVNHRRSNKNTCMHQKPRVPRGKSIKKGQILAEGAATVGGELALGKNVLVAYMPWEGYNFEDAVLISERLVYEDIYTSFHIRKYEIQTDTTSQGSAEKITKEIPHLEEHLLRNLDRNGVVRLGSWVETGDILVGKLTPQIASESSYIAEAGLLRAIFGLEVSTSKETSLKLPIGGRGRVIDVKWIQRDPLDIMVRVYILQKREIKVGDKVAGRHGNKGIISKILTRQDMPYLQDGTPVDVVFNPLGVPSRMNVGQIFESSLGLAGDLLKKHYRIAPFDERYEQEASRKLVFSELYEASKETKNPWVFEPEYPGKSRIFDGRTGDPFEQPVLIGKSYILKLIHQVDEKIHGRSTGPYSLVTQQPVRGRAKQGGQRVGEMEVWALEGFGVAHILQEILTYKSDHLIARQEILNATIWGKRIANHEDPPESFRVLVRELRSLALELNHFLVSEKNFQVNREEI

SEQ ID NO: 6991 - protein, 871 aa, Oryza sativa
MLRNGNEGMSTIPGFSQIQFEGFCRFINQGLAEELEKFPTIKDPDHGISFQLFAKGYQLLEPSIKERDAVYESLTYSSELYVSARLIFGFDVQKQTIYIGNIPIMNSLGTFIINGIYRIVINQILLSPGIYYRSELDHKGISIYTGTIISDWGGRSELAIDKKERIWARVSRKQKISVLVLSSAMGSNLKEILDNVSYPEIFLSFPNAKEKKRIESKEKAILEFYQQFACVGGDLVFSESLCEELQKKFFQQKCELGRIGRRNMNRRLNLDIPQNSTFLLPRDVLAATDHLIGMKFETGILDDDDMNHLKNKRIRSVADLLQDQFGLALGRLQHAVQKTIRRVLIRQSKPTPQTLVTPTSTSILLITTYETFFGTYPLSQVFDQTNPLTQTVHGRKVSCLGPGGLTGRTASFRSRDIHPSHYGRICPIDTSEGINVGLTGSLAIHARIDHWWGSVESPFYEISEKAKKKKERQVVYLSPNRDEYYMIAAGNSLSLNRCIQEEQVVPARYRQEFLTIAWEQIHVRSIFPFQYFSIGGSLIPFIEHNDANRALMSSNMQRQADSRVSVIAEREGKIISTNSHKILLSSSGKTISIPLVTHRRSNKNTCMHQKPRVPRGKSIKKGEILAEGAATVGGELALGKNVLVAYMPWEGYNLEDAVLISERLVYEDIYTSFHIRKYEIQTDTTSQGSAEKITKEIPHLEEHLLRNLDRNGVVKLGSWVETGDILVGKLTPQIASESSYIAEAGLLRAIFGLEVSTSKETSLKLPIGGRGRVIDVKWIQRDPLGIMVRVYILQKREIKVGDKVAGRHGNKGIISKILPRQDMPYLQDGTPVDMVFNPLGVPSRMNVGQIFESSLGLAGDLLKKHYRIATL

SEQ ID NO: 6992 - protein, 971 aa, Brachypodium distachyon
MNSLGTFIINGIYRIVINQILLSPGIYYRSELDHKGISIYTGTIISDWGGRSELAIDKKERIWARVSRKQKISILVLSSAMGSNLKEILDNVSYPEIFLSFPNAKEKKRIESKEKAILEFYQQFACVGGDLVFSESLCEELQKKFFQQKCELGRIGRRNMNRRLNLDIPQNSTFLLPRDVLAATDHLIGMKFETGILDDDDMNHLKNKRIRSVADLLQDQFGLALGRLQHAVQKTIRRVFIRQSKPTPQTLVTPTSTSILLITTYETFFGTYPLSQVFDQTNPLTQTVHGRKVSCLGPGGLTGRTASFRSRDIHPSHYGRICPIDTSEGINVGLTGSLAIHARIDHWWGSVESPFYEISEKAKKKKERQVVYLSPNRDEYYMIAAGNSLSLNRGIQEEQVVPARYRQEFLTIAWEQIHVRSIFPFQYFSIGGSLIPFIEHNDANRALMSSNMQRQAVPLSRSEKCIVGTGLERQTALDSRVSVIAEREGKIISTNSHKILLSSSGKTISIPLVTHRRSNKNTCMHQKPRVPRGKSIKKGQILAEGAATVGGELALGKNVLVAYMPWEGYNFEDAVLISERLVYEDIYTSFHIRKYEIQTDTTSQGSAEKITKEIPHLEEHLLRNLDRNGVVKLGSWVETGDILVGKLTPQIASESSYIAEAGLLRAIFGLEVSTSKETSLKLPIGGRGRVIDVKWIQRDPLDIMVRVYILQKREIKVGDKVAGRHGNKGIISKILPRQDMPYLQDGTPVDMVFNPLGVPSRMNVGQIFESSLGLAGDLLKKHYRIAPFDERYEQEASRKLVFSELYEASKQTKNPWVFEPEYPGKSRIFDGRTGDPFEQPVLIGKSYILKLIHQVDEKIHGRSTGPYSLVTQQPVRGRAKQGGQRIGEMEVWALEGFGVAHILQEILTYKSDHLIARQEILNATIWGKRVPNHEDPPESFRVLVRELRSLALELNHFLVSQKNFQVNREEV

SEQ ID NO: 6993 - protein, 323 aa, Zea mays
MPWEGYNFEDAVLISERLVYEDIYTSFHIRKYEIQTDTTSQGSAEKITKQIPHLEEHLLRNLDRNGVVRLGSWVETGDIFVGKLTPQIASKSSYIAEAGLLRAIFGLEVSTSKETSLKLPIGGIGRVIDVKWIQRDPFDIMVRVYILQKREIKVGDKVAGRHGNKGIISKILPRQDMPYLQDGTPVDMVFNPLGVPSRMNVGQTFESSLGLAGDLLKKHYRIAPFDERYEQEASRKLVFSELYEASKQTKNPWVFEPEYPGKSRIFDGRTGDPFEQPVLIGKSYILKLIHQVDEKIHGRSTRPYSLVTQQPVRGRAKQGGQRI

SEQ ID NO: 6994 - protein, 1070 aa, Vitis vinifera
MFRGGNEGMSTIPGFNQIQFEGFCRFIDQGLTEELYKFPKIEDTDQEIEFQLFVETYQLVEPLIKERDAVYESLTYSSELYVSAGLIWKTSRDMQEQTIFIGNIPLMNSLGTSIVNGLYRIVINQILQSPGIYYRSELDHNGISVYTGTIVSDWGGRLELEIDRKARIWARVSRKQKISILVLSSAMGSNLREILENVCYPEIFLSFLNDKEKKKIGSKESAILEFYQQFACVGGDPVFSESLCKELQKKFFQQRCELGRIGRRNINRRLNLDIPQNNTFLLPQDILAAADHLIGMKFGMGILDDMNHLKNKRIRSVADLLQDQFGLALIRLENVVRGTICGAIRHKLIPTPQNLVTSTPVTTTYESFFGLHPLSQVLDRTNPLTQIVHGRKSSYLGPGGLTGRTASFRIRDIHPSHYGRICPIDTSEGINVGLIGSLAIHARIGHWGSLESPFYEISERSKKVRMLYLSPSRDEYYMVAAGNSLALNQGIQEEQVVPARYRQEFLTIAWEQVHLRSIFPFQYFSIGASLIPFIEHNDANRALMSSNMQRQAVPLSRSEKCIVGTGLERQAALDSGVPVIAEHEGKIVYTDTDKIILSGNGDTLSIPLVMYQRSNKNTCMHQKAQVRRGKCIKKGQILADGAATVGGELALGKNVLVAYMPWEGYNSEDAVLISERLVYGDIYTSFHIRKYEIQTHVTSQGPERITNKIPHLEAHLLRNLDKNGIVILGSWVETGDILVGKLTPQMAKESSYAPEDRLLRAILGIQVSTSKETCLKLPIGGRGRVIDVRWIQKKGGSSYNPETIRVYISQKREIKVGDKVAGRHGNKGIISKILPRQDMPYLQDGRPVDMVFNPLGVPSRMNVGQIFECSLGLAGGLLDRHYRIAPFDEKYEQEASRKLVFSELYEASKQTANPWVFEPEYPGKSRIFDGRTGDPFEQPVIIGKPYILKLIHQVDDKIHGRSSGHYALVTQQPLRGRAKQGGQRVGEMEVWALEGFGVAHILQEMLTYKSDHIRARQEVLGTTIIGGTIPNPEDAPESFRLLVRELRSLALELNHFLVSEKNFQINRKEA

SEQ ID NO: 6995 - protein, 1072 aa, Eucalyptus grandis
MLGDGNEGMSTIPGFNQIQFEGFCRFIDQGLTEELYKFPKIEDTDQEIEFQLFVETYQLVEPLIKERDAVYESLTYSSELYVSAGLIWKTSRDMQEQTLFIGNIPLMNSLGTFIVNGIYRIVINQILQSPGIYYRSELDHNGISVYTGTIISDWGGRLELEIDRKARIWARVSRKQKISILVLLSAMGLNLREILENVCYPEIFLSFLNDKEKKKIGSKENAILEFYQQFACVGGDPVFSESLCKELQKKFFQQRCELGRIGRRNMNRRLNLDIPQNNTFLLPRDILAAADHLIGMKFGMGTLDDMNHLKNKRIRSVADLLQDQFGLALVRLENVVKGTICGAIRHKLIPTPQNLVTSTPLTTTYESFFGLHPLSQVLDRTNPLTQIVHGRKLSYLGPGGLTGRTASFRIRDIHPSHYGRICPIDTSEGINVGLIGSLAIHARIGQGGSLESPFYEISERSKSKKVRMLYLSPSRDEYYMIAAGNSLALNQRIQEEQVVPARYRQEFLTIAWEQVNLRSIFPFQYFSIGASLIPFIEHNDANRALMSSNMQRQAVPLSRSEKCIVGTGLERQAALDSGVTTIAEHEGKIIYTNTDKIILLGNGDTLSIPLVMYQRSNKNTCMHQKPQVPRGKCIKKGQILADGAATVGGELALGKNVLVAYLPWEGYNFEDAVLISERLVYEDIYTSFHIRKYEIQTHVTSQGPERITNEIPHLEAHLLRNLDKNGIVMLGSWVEAGDVLVGKLTPQTAKESSYAPEDRLLRAILGIQVSTSKETCLKLPIGGRGRVIDVRWIQKKGGSNYNPETICVYILQKREIKVGDKVAGRHGNKGIISKILPRQDMPYLQDGRPVDMVFNPLGVPSRMNVGQIFECSLGLAGDLLDRHYRIAPFDERYEQEASRKLVFSELYEASQQTANPWVFEPEYPGKSRIFDGRTGDPFEQPVIIGKPYILKLIHQVDDKIHGRSSGHYALVTQQPLRGRAKQGGQRVGEMEVWALEGFGVAHILQEMLTYKSDHIRARQEVLGTTIIGGTIPKPKDAPESFRLLVRELRSLSLELNHFLVSEKNFQINRKEA

SEQ ID NO: 6996 - protein, 1070 aa, Ricinus communis
MLGDGNEGMSTIPGLNQIQFEGFCRFIDQGLTEELYKFPKIEDTDQEIEFQLFVETYQLVEPLIKEGDAVYESLTYSSELYISAGLIWKTSRDMQEQTIFIGNIPLMNSLGTFIINGIYRIVINQILQSPGIYYRSELDHNGISVYTGTIISDWGGRVELEIDRKARIWARVSRKQKISILVLLSAMGLNLREILENVRYPEIFLSFLNDKEKKKIGSKENAILEFYQQFTCVGGDPVFSESLCKELQKKFFQQRCELGRIGRLNMNRRLNLDIPHNNTFLLPRDILAAADHLIGMKFGMGTLDDMNHLKNKRIRSVADLLQDQFGLALIRLENVVRGTICGAIRHKLIPTPQTLVTSTPLTTTYESFFGLHPLSQVLDRTNPLTQIVHGRKSSYLGPGGLTGRTASFRIRDIHPSHYGRICPIDTSEGINVGLIGSLAIHAKIGHWGSLESPFYVISEESKKVRMFYLSPNREEYHMVAAGNSLALNRGVQEEQVAPARYRQEFLTIAWEQVHLRSIFPFQYFSIGASLIPFIEHNDANRALMSSNMQRQAVPLSRSEKCIVGTGLERQVALDSGVPAIAEREGKIIYTDIDKIILSGNGDTLRIPLVMYQRSNKNTCMHQKPQVPRGKCIKKGQVLADGAATIGGELALGKNVLVAYMPWEGYNFEDAVLISERLVYEDIYTSFHIRKYEIQTHVTSQGPERITNEIPHLEAHLLRNLDKNGIVMLGSWVETGDILVGKLTPQMAKESSYAPEDRLLRAILGIQVSTSKETCLKLPIGGRGRVIDVRWVQKKGGSSYNPETIRIYILQKREIKVGDKVAGRHGNKGIISKILPRQDMPYLQDGRPVDMVFNPLGVPSRMNVGQIFECSLGLAGGLLDRHYRIAPFDERYEQEASRKLVFSELYEASKQTANPWVFEPEYPGKSRIFDGRTGDPFEQPVIIGKPYILKLIHQVDDKIHGRSSGHYALVTQQPLRGRAKQGGQRVGEMEVWALEGFGVSHILQEMLTYKSDHIRARQEVLGTTIIGGTIPKPEDAPESFRLLVRELRSLALELNHFLVSEKNFQMNRKEA

SEQ ID NO: 6997 - protein, 1337 aa, Brachypodium distachyon
MGSNLKEILDNVSYPEIFLSFPNAKEKKRIESKEKAILEFYQQFACVGGDLVFSESLCEELQKKFFQQKCELGRIGRRNMNRRLNLDIPQNSTFLLPRDVLAATDHLIGMKFETGILDDDDMNHLKNKRIRSVADLLQDQFGLALGRLQHAVQKTIRRVFIRQSKPTPQTLVTPTSTSILLITTYETFFGTYPLSQVFDQTNPLTQTVHWRKVSCLGPGGLTGRTASFRSRDIHPSHYGRICPIDTSEGINVGLTGSLAIHVRIDHWWGSVESPFYEISEKAKKKKERQVVYLSPNRDEYYMIAAGNSLSLNRGIQEEQVVPARYRQEFLTIAWEQIHVRSIFPFQYFSIGGSLIPFIEHNDANRALMSSNMQRQAVPLSRSEKCIVGTGLERQTALDSRVSVIAEREGKIISTNSHKILLSSSGKTISIPLVTHRRSNKNTCMHQKPRVPRGKSIKKGQILAEGAATVGGELALGKNVLVAYMPWEGYNFEDAVLISERLVYEDIYTSFHIRKYEIQTDTTSQGSAEKITKEIPHLEKHLLRNLDRNGVVKLGSWVETGDILVGKLTPQIASESSYIAEAGLLRAIFGLEVSTSKETSLKLPIGGRGRVIDVKWIQRDPLDIMVRVYILQKREIKVGDKVAGRHGNKGIISKILPRQDMPYLQDGTPVDMVFNPLGVPSRMNVGQIFESSLGLAGDLLKKHYRIAPFDERYEQETSRKLVFSELYEASKQTKNPWVFEPEYPGKSRIFDGRTGDPFEHPVLIGKSYILKLIHQVDEKIHGRSTGPYSLVTQQPVRGRAKQGGQRIGEMEVWALEGFGVAHILQEILTYKSDHLIARQEILNATIWGKRVPNHEDPPESFRVLVRELRSLALELNHFLVSQKNFQRVIRRNNNLAYLLKRSELAPADLVMCQEKLVQEAVDTLLDSGSRGQPTRDGHNKVYKSLSDVIEDFDGDQMAVHLPLSLEAQAEARLLMFSHMNLLSPAIGDPICVPTQDMLIGLYVLTIGNRRGARGNASQVHQLVGMRGLMADPQGQMIDLPIQSNLREGLSLTEYIISCYGARKGVVDTAVRTADAGYLTCRLVEVVQHIIVRRRDCGTIQAISSQDILYSVNIPSKSLILVQNDQYVKSKQVIAEIRAGTSTLHFKERTEKCTGVLMFIMRPNINMVILVDYQKQVIYGYCQNTIFAYFDDPQYRKDKKGSGIVKFRYRTLEYEYRIREEYSEDKYETLEDEYRIREEYSEDKYETLEDEYETLYKNEILQDEYEYETLEDAYGRPENEYGNLENEYRTLEKDSEDEYRSPESKYRTREDKYGTLEEDSEDEYESFRGRLRRRLRRRI

SEQ ID NO: 6998 - protein, 1427 aa, Oryza sativa
MGSNLKEILDNVSYPEIFLSFPNAKEKKRIESKEKAILEFYQQFACVGGDLVFSESLCEELQKKFFQQKCELGRIGRRNMNRRLNLDIPQNSTFLLPRDVLAATDHLIGMKFETGILDDDDMNHLKNKRIRSVADLLQDQFGLALGRLQHAVQKTIRRVFIRQSKPTPQTLVTPTSTSILLITTYETFFGTYPLSQVFDQTNPLTQTVHWRKVSCLGPGGLTGRTASFRSRDIHPSHYGRICPIDTSEGINVGLTGSLAIHVRIDHWWGSVESPFYEISEKAKKKKERQVVYLSPNRDEYYMIAAGNSLSLNRGIQEEQVVPARYRQEFLTIAWEQIHVRSIFPFQYFSIGGSLIPFIEHNDANRALMSSNMQRQAVPLSRSEKCIVGTGLERQTALDSRVSVIAEREGKIISTNSHKILLSSSGKTISIPLVTHRRSNKNTCMHQKPRVPRGKSIKKGQILAEGAATVGGELALGKNVLVAYMPWEGYNFEDAVLISERLVYEDIYTSFHIRKYEIQTDTTSQGSAEKITKEIPHLEKHLLRNLDRNGVVKLGSWVETGDILVGKLTPQIASESSYIAEAGLLRAIFGLEVSTSKETSLKLPIGGRGRVIDVKWIQRDPLDIMVRVYILQKREIKVGDKVAGRHGNKGIISKILPRQDMPYLQDGTPVDMVFNPLGVPSRMNVGQIFESSLGLAGDLLKKHYRIAPFDERYEQETSRKLVFSELYEASKQTKNPWVFEPEYPGKSRIFDGRTGDPFEHPVLIGKSYILKLIHQVDEKIHGRSTGPYSLVTQQPVRGRAKQGGQRIGEMEVWALEGFGVAHILQEILTYKSDHLIARQEILNATIWGKRVPNHEDPPESFRVLVRELRSLALELNHFLVSQKNFQRVIRRNNNLAYLLKRSELAPADLVMCQEKLVQEAVDTLLDSGSRGQPTRDGHNKVYKSLSDVIEDFDGDQMAVHLPLSLEAQAEARLLMFSHMNLLSPAIGDPICVPTQDMLIGLYVLTIGNRRGARGNASQVHQLVGMRGLMADPQGQMIDLPIQSNLREGLSLTEYIISCYGARKGVVDTAVRTADAGYLTCRLVEVVQHIIVRRRDCGTIQAISSQDILHSVTIPSKSLILVQNDQYVESEQVIAEIRAGTSALHFKEKMGKCTGVPMFIMRPNINMVIFVDYQKQANYGYCQNTIVAYFDDPRYKKDKKGSGIVKFRYRTLEDEYRTREKDSENEYGSPENEYRTREEECKTLEDEYRTREEEYETLEDEYGIPENEYETLEDEYGILEDEYRTREEESEDEYGSPENKYRPREDKYGTLEEDSEVEHGTLEEDSEEDSEDEYGNPGEDSVLKKGVLIEHRGTKEFSLKYQKEVDRFFFILQELHILPRSSSLKLNWHFLPHDSWEETSAKIHLGQFICENEQLFMVIMEKSFTKGIG

SEQ ID NO: 6999 - protein, 1070 aa, Cannabis sativa
MLGDGNGKMSTIPGFNQIQFEGFCRFIDQGLTEELYKFPKMEDTDQEIEFQLFVETYQLAEPLIKERDAVYESLTYSSELYVSAGLIWKTSRDMQEQTIFIGNIPLMNSLGTSIVNGIYRIVINQILQSPGIYYRSELDHNGISVYTGTIISDWGGRLELEIDRKARIWARVSRKQKISILVLSSAMGSNLREILENVCYPEIFLSFLNDKEKKKIKSKENAILEFYQQFACVGGDPVFSESLCKELQKKFFQQRCELGRIGRRNMNRRLNLDIPQNNTFLLPRDILAAADHLIGMKFGMGILDDMNHLKNKRIRSVADLLQDQFGLALVRLENMVRGTMSGAIRHKLIPTPQNLVTSTTLTTTFESFFGLHPLSQVLDRTNPLTQIVHGRKLSYLGPGGLTGRTASFRIRDIHPSHYGRICPIDTSEGINVGLIGSLSIHARIGPWGSLESPFYEISERSKKVRMLYLSPSRDEYYMVAAGNSLALNRGSQEEQVVPARYRQEFLTIEWEQVHLRNIFPFQYFSIGASLIPFIEHNDANRALMSSNMQRQAVPLSRSEKCIVGTGLESQVALDSGVPAIAEHEGKIVYTDTDKIILSGNGDTLSIPLVRYQRSNKNTCMHQKPQVARGKCIKKGQILADGAATVGGELSLGKNVLVAYMPWEGYNFEDAVLINERLVYGDIYTSFHIRKYEIQTHVTSHGPERITNEIPHLEAHLLRNLDKKGVVMLGSWVETGDILVGKLTPQMAKESSYAPEDRLLRAILGIQISTSKETCLKLPIGSRGRVIDVRWIQKKGGSSYNPETIRVYISQKREIKVGDKVAGRHGNKGIVSKILPRQDMPYLQDGRPVDMVFNPLGVPSRMNVGQIFECSLGLAGELLDRHYRIAPFDERYEQEASRKLVFSELYEASKQTANPWVFEPEYPGKSRIFDGRTGDPFEQPVIIGKPYILKLIHQVDDKIHGRCSGHYALVTQQPLRGRAKQGGQRVGEMEVWALEGFGVAHILQEMLTYKSDHIRARQEVLGTTIIGGPIPKPEDAPESFRLLVRELRSLALELNHFLVSEKNFQINRKDA

SEQ ID NO: 7000 - protein, 1393 aa, Cannabis sativa
MEVLMAERAGLVFHNKVIDGTAIKRLISRLIDHFGMAYTSHILDQVKTLGFRQATATSISLGIDDLLTIPSKGWLVQDAEQQSLILEKHHHYGNVHAVEKLRQSIEIWYATSEYLRQEMNPNFRMTDPFNPVHMMSFSGARGNASQVHQLVGMRGLMSDPQGQMIDLPIQSNLREGLSLTEYIISCYGARKGVVDTAVRTSDAGYLTRRLVEVVQHIVVRRTDCGNIRGISVSSRNGMMSERIFIQTLIGRVLADDIYIGPRCIAVRNQDIGIGLVNRFITFQTQPISIRTPFTCKSTSWICRLCYGRSPTHGDLVELGEAVGIIAGQSIGEPGTQLTLRTFHTGGVFTGGTAEHVRAPSNGKIKFNEDLAHPTRTRHGHPAFLCSIDLDVIIESEDIIHNVTIPPKSLILVQNDQYVESEQVIAEIRARTSTFNFKEKVRKHIYSDSEGEMHWSTDVYHAPDFTYSNVHLLPKTSHLWILSGSSYRSSVVPFSIHKDQDQTNVYFLSAEGKNISSRSVNTVNNDQGKGKFFSSDFSGKKESTIPDYSEFNRIIDRDHWNLIFPSILHKNYDLFLLAKRRRNRFIIPFQWIQERENELMLRSSISIEIPINGVFRKNSILAYFDDPQYRRKSSGITKYGAIGLHSIFKKEDLIEYVGIKELKPKYQTKVDRFFFIPEEVHILPESSSIMVRNNSIIGINTQITLNTRSRVGGLVRVEKKKKRIELKIFSGEIQFPVEMDKIFRHSGILIPPGRVKKKIKESKKLKNWIYVQWITPTKKKYFVLVRPVIIYEIADGINLETLFPQDLLQEKDNLELRVVNYILYGNGKPILGISGTSIQLVRTCLMLNWDQDNKSSSSEEAHVYFVEVSTTGLIRDFLRINLAKSNICYIRKRNDPLGSGLISDNRSDCTNPFYSIYSKEKIQQSLRQNQGTIHTLLNRSKESQSLIILSSSNCFQMSPFKDVQYSNGIKESIKVEPLIPIRNSLGPLGTSSQIENFYYLLKTHNQISVTKYLQLDNFTQPFQVLQYYLMDENGIVYNSDPCSNTRLNPFNLNWHFFHNNYDNNYYQKKSPIISLGRFFCENVCIVKHGPHLKSGQVIIVQIDSVVIRLAKPYLATPGATVHGHYGEKLSEGDTLVTFIYEKSRSGDITQGLPKVEQVLEVRSIDSISMNLEKRVEGWNDLLTRILGIPWGFLIGAELTIVQSRISLVNKIQKVYRSQGVQIHNRHIEIIVRQITSKVVVSEDGMSNVFLPGELIGLLRAERTGRALEEAICYRAILLGITKASLNTQSFISEASFQETARVLAKAALRGRIDWLKGLKENVVLGGMIPVGTGFKGLVHCSRKHNNIPLEPKNKNLFEWEMRDILFHHRELFSFCISKNVQDTSEQSFIGFNDS

SEQ ID NO: 7001 - protein, 1072 aa, Amborella trichopoda
MLRDGNEGMSTIPGFSQIQFEGFCRFVDQGLAEELHKFPKIEDTDQEIEFQLLVETYQLAEPLIKERDAVYESLTHSSELYVPAGLIWKVGRDMQEQTVFIGNIPLMNSLGTFIVNGIYRIVINQILQSPGIYYSSELDHNGISVYTGTIISDRGGRSELEIDRKARIWARVSRKQKISILVLPSAMGSNLREILDNVCYPEILLYFPNEKEKKKIGSKENAILEFYQQFSCVGGDPVFSESLCKELQKRFFQQRCELGRIGRQNMNQRLNIDIPQNNTFLLPRDVLAATDHLIGMKFGMGTLDDMNHLKNKRIRSVADLLQDQFGLALVRLENVVRGTICGAIRHKFIPTPQNLVTSTPLTTTYESFFGLHPLSQVLDRTNPLTQIVHGRKSSYLGPGGLTGRTASFRIRDIHPSHYGRICPIDTSEGINVGLIGSLAIHARIGDWGSIRSPFYEISERSKEEQMVYLSPRRDEYYMVMVAAGNSLALNQDIQDEQVVPARYRQEFVTIAWEHIDLRSIYPLQYFSIGASLIPFIEHNDANRALMSSNMQRQAVPLSRSEKCIVGTGLERQAALDSGGSAIAQHEGKVIYTDTEKILLSGNGDTISIPLLMYQRSNKNTCMHQKPQVHRDKYVKKGQVLADGAATVGGELALGKNVLVAHMPWEGYNFEDAVLISERLVYGDIYTSFHIRKYEIQTHVTSHGPEKITNEIPHLEAHLLRNLDRNGIVMLGSWVETGDVLVGKLTPQTAKESSYAPEDRLLRVILGIQVSTAKETCLKLPIGGRGRVIDVRWIQKKGASSYNPEKIRVYISQKREIKVGDKVAGRHGNKGIISKILPRQDMPYLQDGTPVDMVFNPLGVPSRMNVGQIFECSLGLAGDLLDRHYRITPFDERYEQEASRKLVFPELYEASKRTANPWVFEPEYPGKSRIFDGRTGDPFEQPVIIGKSYMLKLIHQVDDKIHGRSSGHYALVTQQPLRGRAKQGGQRVGEMEVWALEGFGVAHILQEMLTYKSDHIRARQELLGTTIVGGTIPKPEGAPESFRLLVRELRSLALELKHFLVSEKNFQINRKEA

SEQ ID NO: 7002 - protein, 1068 aa, Malus domestica
MLGGGNEAISTIPGFNQIQFEGFCRFIEQGLTEELYKFPKIEDTDQEIEFQLFVETYQLVEPLIKERDAVYESRTYSSELYVSAGLVWKNSRDMQEQTIFIGNIPLMNSLGTSIVNGIYRIVINQILQSPGIYYRSELDHNGISVYTGIIISDWGGRLELEIDRKARIWARVSRKQKISILVLLSAMGSNLREILENVCYPEIFLSFLNDKEKKKIGSKENAILEFYQQFACVGGDPVVSESLCKELQKKFFQQRCELGRVGRRNMNRRLNLDIPQNNIFLLPRDILAAADHLIGMKFGMGTLDDMNHLKNKRIRSVADLLQDQFGLALVRLENMVRGTICGAIKHKLIPTPQNLVTSTPLTTTYESFFGLHPLSQVLDRTNPLTQIVHGRKSSYLGPGGLTGRTASFRIRDIHPSHYGRICPIDTSEGINVGLIGSLAIHAKIGYWGSLESPFYEISERSKRMLYLSPSKDEYYMVAAGNSLALNRGIQEEQVVPARYRQEFLTIEWEQVHFRSIFPFQYFSIGASLIPFIEHNDANRALMSSNMQRQAVPLSRSEKCIVGTGLERQVALDSGVTAIAEHEGKVIYTDTDKIILSGNGATRNIPLVIYQRSNKNTCMHQKPQVRRGKCIKKGQILADGAATVGGELALGKNVLVAYMPWEGYNSEDAVLISERLVYGDIYTSFHIRKYEIQTHVTSNGPERITNEIPHLEAHLLRNLDKNGIVRLGSWVKTGDILVGKLTPQMAKESSYAPEDRLLRAILGIQVSTSKETCLKLPIGGRGRVIDVRWIQKKGGSSYNPETIRVYISQKREIKVGDKVAGRHGNKGIVSKILSRQDMPYLQDGRPVDMVFNPLGVPSRMNVGQIFECSLGLAGGLLDRHYRIAPFDERYEQEASRKLVFSELYEASKQTANPWVFEPEYPGKSRIFDGRTGDPFEQPVIIGKPYILKLIHQVDDKIHGRSSGHYALVTQQPLRGRAKQGGQRVGEMEVWALEGFGVAHILQEMLTYKSDHIRARQEVLGTTIIGGTIPKPEDAPESFRLLVRELRSLALELNHFLVSEKNFQINRKEA

SEQ ID NO: 7003 - protein, 1373 aa, Amborella trichopoda
MEVLMAERADLVFHNKAIDGTAMKRLISRLIDHFGMAYTSHILDQVKTLGFRQATLTSISLGIDDLLTTPSKGWLVQDAEQQSLILEKHHHYGNVHAVEKLRQSIEIWYATSEYLRQEMNPNFRMTDPFNPVYIMSFSGARGNASQVHQLVGMRGLMSDPQGQMIDLPIQSNLREGLSLTEYTISCYGARKGVVDTAVRTSDAGYLTRRLVEVVQHIVVRRTDCGTIRGISVSPRNGVGVTERIFIQTLIGRVLANDVYMGLRCIATRNQDIGIGLVNRFITSRAQPIYIRSPFTCRSTSWICQLCYGRSTTHGNLVELGEAVGIIAGQSIGEPGTQLTLRTFHTGGVFTGGIAEHVRAPSNGKIKFNEDLVHPTRTRHGHPAFLCHIDLHVTIESQDIIHKVNIPPKSFLLVQNDQYVESEQVIAEIRAGTSTLKERVQKHIYSDSEGEMHWSTDVYHTPEYTHGNVHLLPKTSHLWVLSGSPCRSSIVPFPLHKDQDQMNVQSLYVEERYISDLSMNNDRVRHKLFGWDQKRGRVSYYSGPDRIISNRNWDSIYPLILHENSDLLAKRRRNRFIIPFQYDQEQEKELRPPGIVIKIPIKGILRRNSILAYFDDPRYRRSSSGIAKYGTIEVDSIIKKEDLIEYRKTREFGPKYQIQIKVNRFFFIPEEVHILPRSSSIMVRNNSIIGVDTRITLNIRSQVGGLVRVEKKKKRIELKISSGDIHFPGETDNIARYSGILIPPGRVKNTESKFKNWIYVQRITPIKKKYFVSVRPVVTYEIADGINLATFFPQDLLQEKNNLQLRVVNYILYGDGKPIRGIFHTSIQLVRTCLVLNWDQDRAGSIEEEEAYTSLAEVRVNDLIRNFIRIDLVKSPISSTGKENDMAGSGLIPNNGSDRINTNPFFSKAKTQSLSQHQGTIRTLLNRNKEGQGESLMVLSSSNCSRIGPLNGSKYHNVTKESIQEDPMISIRNSLGPLGTVPNILNFSSSYHSITHNEILFNKYLLPDNSRETFLVPKSYFMDENRRIYNLDPCSNIILTPFNLNWCFLHHDYWEDTSTIISLGQFLCENICISKDGPCVKSGQIIIVHVDSLVIRLAKYHLATRGATVHGHYGEILYEGDTLVTFIYEKSRSGDITQGLPKVEQVLEVRSIDSISMNLEKRVEGWNERITGFLGIPWEFFISAQLTIVQSRISLVNKIQKVYRSQGVQIHNRHIETIVRQITSKVLVSEDGMSNVFSPRELIGLLRAERIGRALEDDICYRAILLGITRASLNTQSFISEASFQETTRVLAKAALRSRIDWLKGLKENVVLGGMIPVGTGFKGFVHHSREHNNISLEIKKKNLFDGKMRDILFYHREFCGSCIPKNFHDTSEQ

SEQ ID NO: 7004 - protein, 487 aa, Setaria italica
MDATYTAAAGPEQRASLLCTPKHRVAAGGRRSLSFTARASLNSGAKVSIPKQWYNLVADLPVKPPPPLHPQTHQPLNPSDLSPLFPDELIRQEVTDERFVDIPEEVIDVYKLWRPTPLIRARRLEKLLGTPAKIYYKYEGTSPAGSHKPNTAVPQAWYNAAAGVKNVVTETGAGQWGSALSFASSLFGLNCEVWQVRASFDQKPYRRLMMETWGAKVHPSPSEATEAGRKILAADPTSPGSLGIAISEAVEVAATDAATKYCLGSVLNHVLLHQTVIGEECLEQLAALGEAPDIVIGCTGGGSNFGGLAFPFMREKLAGRMSPEFRAVEPAACPTLTKGIYAYDFGDTAGLTPLMKMHTLGHGFVPDPIHAGGLRYHGMAPLISHVYELGFMDAVAIQQTECFQAALQFARTEGIIPAPEPTHAIAAAIREAMECKKTGEEKVILMAMCGHGHFDLAAYEKYLRGDMVDLSHSADKLEASLAAVPKV

SEQ ID NO: 7005 - protein, 409 aa, Zea mays
MSLSIHQESKWRQQEVTDERFVDIPEEVIDVYKLWRPTPLIRARRLEKLLGTPAKIYYKYEGTSPAGSHKPNTAVPQAWYNAAAGVKNVVTETGAGQWGSALSFASSLFGLNCEVWQVRASFDQKPYRRLMMETWGAKVHPSPSTATEAGKRILEADPSSPGSLGIAISEAVEVAATSADTKYCLGSVLNHVLLHQTVIGEECLEQLAALGETPDVVIGCTGGGSNFGGLAFPFLREKLRGKMSPAFRAVEPAACPTLTKGVYAYDFGDTAGLTPLMKMHTLGHGFVPDPIHAGGLRYHGMAPLISHVYELGFMDAVAIQQTECFQAALQFARTEGIIPAPEPTHAIAAAIREALECKRTGEEKVILMAMCGHGHFDLAAYEKYLRGDMVDLSHPADKLEASLAAVPKV

SEQ ID NO: 7006 - protein, 546 aa, Sorghum bicolor
MGPFHIPSTSGPRKFYHLVLFHVHPFWIQLLYFLSISVLGFLMLRALPMKSISVPRPSALDLVFTSVSATTVSSMVAVEMESFSNSQLLLMTLLMLLGGEVFTSMLGLHFTFTKFIKKREIPHSNNNSLHGNINGPAPAAPSSLEHGHRRRPMEMEAQAAAVQMELAGFNNDDQRDFASIARLLMFIVLGYLSVVHLAGYTLILIYLSVVGSAREVLVGKRISLSTFSVFTVVSTFANCGFVPTNEGMASFKSFPGMLLLVMPHILLGNTLFPVFLRLSITALERVTRRGDLRELLRDGGPGGGGGGGGGPAAAAIGYDHLLPGGRTWCLALTVAVFLAGQLLLYCAMEWGSDGLRGLTAFQKLVAALFMSVNSRHSGEMVVDLATVSSAIVVLYVLMMYLPPYTTFLPIAMEDHQQQQNEAQSDDKSKSSSSISIWQKLLMSPLSCLTIFIVVICITERRQIADDPINFSVLNIVVEVISAYGNVGFSTGYSCSRQVTPDGSCRDAWVGFSGKWSREGKLTLMAVMFYGRLKKFSMHGGQAWKLG

SEQ ID NO: 7007 - protein, 384 aa, Sorghum bicolor
MAATASLKSSLLLPSPISDFSGAAVSISVSAQKRRSSWQPRGARVQVSAAAAADSKNILVMGGTRFIGVFLSRILVKEGHQVTLFTRGKAPITQQLPGESDAEYAEFSSKVQHLKGDRQDFEFVKTSLAAKGYDVVYDINGREAVQVEPIIDALPNLEQYIYCSSAGVYLKSDILPHCEVDAVDPKSRHKGKLETESLLTSRGVNWTSIRPVYIYGPLNYNPVEEWFFHRLKAGRPIPIPGAGNQITQLGHVKDLARAFNLVLGNPKASQQIFNISGAKYVTFDGLARACAKAGGFPEPELVHYNPKDFDFGKKKAFPFRDQHFFASVEKAISELGWTPEFDLVDGLTDSYNLDFGRGTFRKAADFTTDDIILGKKLATTRALI

SEQ ID NO: 7008 - protein, 376 aa, Setaria italica
MAATASLKSSFLLPSPISDFSGAAVSVSTQKRRRSWQPRGARIQVSAAADSKNILVMGGTRFIGVFLSRLLVKEGHQVTLFTRGKAPITQQLPGESDAEYAEFSSKIQHLKGDRMDFEFVKTSLAAKGYNVVYDINGREAVEVEPIIEALPNLEQYIYCSSAGVYLKSDLLPHCESDAVDPKSRHKGKLETESLLTSRGVNWTSIRPVYIYGPLNYNPVEEWFFHRLKEGRPIPIPGAGNQITQLGHVKDLATAFNLVLGNPKASQQIFNISGAKYVTFDGLARACAKAGGFPEPELVHYNPKDFDFGKKKAFPFRDQHFFASIEKATRELGWTPEFDLVEGLTDSYNLDFGRGTFRKAADFTTDDMILGKKLATV

SEQ ID NO: 7009 - protein, 376 aa, Cynodon dactylon
MAATASLKSSLLLPSRISDFSGAAVSISTQKRRRSCQSRGARMQVSAAADSKNILVMGGTRFIGVFLSRLLVKEGHQVTLFTRGKAPITQQLPGEPDAEYAEFSSKILHLKGDRQDFDFVKTSLAAKGFDVVYDINGREAVEVTPILDALPNLEQYIYCSSAGVYLKSDLLPHCETDAVDPKSRHKGKLETESLLTSRGVNWTSIRPVYIYGPLNYNPVEEWFFHRLKAGRPIPIPGAGNQITQLGHVKDLAAAFIKVLGHPKASQQIFNISGAKYVTFDGLARACAKAGGFPEPELVHYNPKDFDFGKKKAFPFRDQHFFASIEKATRELGWTPEFDLVEGLTDSYNLDFGRGTFRKEADFTTDDVILDKKLAAV

SEQ ID NO: 7010 - protein, 377 aa, Panicum virgatum
MAATASLKSSLRLPSPISDFSGAAVSVSAQKSRRSWQPRGARVQVSAAAADSKNILVMGGTRFIGVFLSRLLVKEGHQVTLFTRGKAPITQQLPGESDAEYAEFSSKIQHLKGDRMDFEFVKASLAAKGYDVVYDINGREAAEVEPIIDALPDLEQYIYCSSAGVYLKSDLLPHCEADAVDPKSRHKGKLETESLLTARGVNWTSIRPVYIYGPLNYNPVEEWFFHRLKAGRPIPIPGAGNQITQLGHVKDLAAAFNLVLGNPKASQQIFNISGAKYVTFDGLARACAKAGGFPEPELVHYNPKEFDFGKKKAFPFRDQHFFASIEKATRELGWTPEFDLVEGLTDSYNLDFGRGTFRKAADFTTDDMILGKKLATV

SEQ ID NO: 7011 - protein, 376 aa, Oryza sativa
MAATASLKSSLLLPSPISDFSSAALSISTQARRRSWQPRGARMQVAAAADSKNILVMGGTRFIGVFLSRLLVKEGHQVTLFTRGKAPITQQLPGESDAEYAEFSSKVLHLKGDRQDFDFVKTSLAAKGFDVVYDINGREAVEVAPILDALPNLEQYIYCSSAGVYLKSDLLPHFETDAVDPKSRHKGKLETESLLETRDVNWTSIRPVYIYGPLNYNPVEEWFFHRLKAGRPIPVPGAGNQITQLGHVKDLATAFVLALGNPKASKQVFNISGAKYVTFDGLARACAKAGGFPEPEIVHYNPKDFDFGKKKAFPFRDQHFFASIEKATLELGWKPEYDLVEGLTDSYNLDFGRGTFRKAADFTTDDMILGKKLVSV

SEQ ID NO: 7012 - protein, 377 aa, Festuca arundinacea
MAAAMASLKSSLLLPSPLSDFSGAAVSISTQHRRKSWQPRGARMQVAAAADAKNILVMGGTRFIGLFLSRQLIKEGHQVTLFTRGKAPITQQLPGESDAEYAEFSSKVLHLKGDRQDFDFVKTSLSAKGFDVVYDINGREATQVSPILDALPNLEQFIYCSSAGVYLKSDLLPHFETDAVDPKSRHKGKLETESLLETSGVNWTSIRPVYIYGPLNYNPVEEWFFHRLKAGRPIPIPGAGNQITQLGHVKDLAEAFTRVLGNPKASKQVYNISGAKYVTFDGLAKACAKAGGFPEPEIVHYNPKDFDFGKKKAFPFRDQHFFASVEKASKDLGITPEFDLVDGLTDSYNLDFGRGTFRKEADFTTDDMILGKKLVSV

SEQ ID NO: 7013 - protein, 377 aa, Avena sativa
MAAAMASLKSSLLLPSPLSDFSGAAVSISAQNRRKSWQPRGARMQVAAAADSKNILVMGGTRFIGLFLSRQLIKEGHQVTLFTRGKAPITKQLPGESDAEYAEFSSKVLHLKGDRQDFDFVKTNLSAKGFDVVYDINGREATEVAPILDALPNLEQFIYCSSAGVYLKSDLLPHFETDAVDPKSRHKGKLETESLLETSGVNWTSIRPVYIYGPLNYNPVEEWFFHRLKAGRPIPIPGAGNQITQLGHVKDLAEAFIKVLGNPKASKQVYNISGAKYVTFDGLARACAKAGGFPEPEIVHYNPKDFDFGKKKAFPFRDQHFFASVEKASKDLGITPAFDLVEGLTDSYNLDFGQGTFRKEADFTTDDMILGKKLVTV

SEQ ID NO: 7014 - protein, 342 aa, Avena sativa
MAAKGGEECRWRQPQTARTFLSWGEPRFIGLFLSRQLIKEGHQVTLFTRGKAPITKQLPGESDAEYAEFSSKVLHLKGDRQDFDFVKTNLSAKGFDVVYDINGREATEVAPILDALPNLEQFIYCSSAGVYLKSDLLPHFETDAVDPKSRHKGKLETESLLETSGVNWTSIRPVYIYGPLNYNPVEEWFFHRLKAGRPIPIPGAGNQITQLGHVKDLAEAFIKVLGNPKASKQVYNISGAKYVTFDGLARACAKAGGFPEPEIVHYNPKDFDFGKKKAFPFRDQHFFASVEKASKDLGITPAFDLVEGLTDSYNLDFGQGTFRKEADFTTDDMILGKKLVSV

SEQ ID NO: 7015 - protein, 377 aa, Avena sativa
MAAAMASLKSSLLLPSPLSDFSGAAVSISAQNRRKSWQPRGARMQVAAAADSKNILVMGGTRFIGLFLSRQLIKEGHQVTLFTRGKAPITKQLPGESDAEYAEFSSKVLHLKGDRQDFDFVKTNLSAKGFDVVYDINGREATEVAPILDALPNLEQFIYCSSAGVYLKSDLLPHFETDAVDPKSRHKGKLETESLLETSGVNWTSIRPVYIYGPLNYNPVEEWFFHRLKAGRPIPIPGAGNQITQLGHVKDLAEAFIKVLGNPKASKQVYNISGAKYVTFDGLARACAKAGGFPDPEIVHYNPKDFDFGKKKAFPFRDQHFFASVEKASKDLGITPAFDLVEGLTDSYNLDFGQGTFRKEADFTTDDMILGKKLVTV

SEQ ID NO: 7016 - protein, 377 aa, Avena sativa
MAAAMASLKSSLLLPSPLSDFSGAAVSISAQNRRKSWQPRGARMQVAAAADSKNILVMGGTRFIGLFLSRQLIKEGHQVTLFTRGKAPITKQLPGESDAEYAEFSSKVLHLKGDRQDFDFVKTNLSAKGFDVVYDINGREATEVAPILDALPNLEQFIYCSSAGVYLKSDLLPHFETDAVDPKSRHKGKLETESLLETSGVNWTSIRPVYIYGPLNYNPVEEWFFHRLKAGRPIPIPGAGNQITQLGHVKDLAEAFIKVLGNPKASKQVYNISGAKYVTFDGLARACAKAGGFPEPEIVHYNPKDFDFGKKKAFPFRDQHFFASVEKASKDLGITPAFDLVEGLTDSYNLDFGQGTFRKEADFTTDDMILGKKLVSV

SEQ ID NO: 7017 - protein, 377 aa, Leymus cinereus x Leymus triticoides
  misc_feature (74)..(74): Xaa can be any naturally occurring amino acid
MAAASVSLKSSLFLSSPLSDFGGAAISISAQNRRRSWQPRGARMQVAAAADSKNILIMGGTRFIGLFLSRKLVXEGHQVTLFTRGKAPITQQLPGESDAEYAEFSSKVLHLKGDRKDFDFVKTSLSAKGFDVVYDINGREATEVSPILEALPNLEQFIYCSSAGVYLKSDLLPHFETDAVDPKSRHKGKLETESLLETSGVNWTSIRPVYIYGPLNYNPVEEWFFHRLKAGRPIPIPNAGNQITQLGHVKDLATAFIKVLGNPKASKQVYNISGSKYVTFDGLARACAKAGGFPEPEIIHYNPKDFDFGKKKAFPFRDQHFFASVEKASKDLGVTPEYDLLDGLTDSYNLDFGRGTFRKEADFTTDDMILGKKLVSV

SEQ ID NO: 7018 - protein, 377 aa, Triticum aestivum
MAAASVSLKSSLFLSSPLSDFGGAAISISAQNRRRSWQPRGARMQVAAAADSKNILIMGGTRFIGLFLSRKLVQEGHQVTLFTRGKAPITQQLPGESDAEYAEFSSKVLHLKGDRKDFDFVKTSLAAKGFNVVYDINGREATEVSPILEALPNLEQFIYCSSAGVYLKSDLLPHFETDAVDPKSRHKGKLETESLLETSGVNWTSIRPVYIYGPLNYNPVEEWFFHRLKAGRPIPIPNAGNQITQLGHVKDLATAFIKVLGNPKASKQVYNISGSKYVTFDGLARACAKAGGFPEPEIIHYNPKDFDFGKKKAFPFRDQHFFASVEKASKDLGVTPEYDLLDGLTDSYNLDFGRGTFRKEADFTTDDMILGKKLVSV

SEQ ID NO: 7019 - protein, 377 aa, Leymus cinereus x Leymus triticoides
MAAASVSLKSSLFLSSPLSDFGGAALSVSAQNRRRSWQPRGARMQVAAAADSKNILVMGGTRFIGLFLSRKLVKEGHQVTLFTRGKAPVTQQLPGESDAEYAEFSSKVLHLKGDRQDFDFVKTNLSAKGFDVVYDINGREATEVAPILEALPNLEQFIYCSSAGVYLKSDLLPHFETDAVDPKSRHKGKLETESLLETSGVNWTSIRPVYIYGPLNYNPVEEWFFHRLKAGRPIPIPGAGNQITQLGHVKDLATAFIRVLGNPKASKQVYNISGSKYVTFDGLARACAKAGGFPEPEIIHYNPKDFDFGKKKAFPFRDQHFFASVEKASKDLGVTPEYDLLDGLTDSYNLDFGRGTFRKEADFTTDDMILGKKLVSV

SEQ ID NO: 7020 - protein, 377 aa, Unknown
  Sequence found in Organisms: Hordeum vulgare, Secale cereale, Triticum aestivum
MAAASVSLKSSLFLSSPLSDFGGAAISISAQNRRRSWQPRGARMQVAAAADSKNILIMGGTRFIGLFLSRKLVQEGHQVTLFTRGKAPITQQLPGESDAEYAEFSSKVLHLKGDRKDFDFVKTSLSAKGFNVVYDINGREATEVSPILEALPNLEQFIYCSSAGVYLKSDLLPHFETDAVDPKSRHKGKLETESLLETSGVNWTSIRPVYIYGPLNYNPVEEWFFHRLKAGRPIPIPNAGNQITQLGHVKDLATAFIKVLGNPKASKQVYNISGSKYVTFDGLARACAKAGGFPEPEIIHYNPKDFDFGKKKAFPFRDQHFFASVEKASKDLGVTPEYDLLDGLTDSYNLDFGRGTFRKEADFTTDDMILGKKLVSV

SEQ ID NO: 7021 - protein, 377 aa, Pseudoroegneria spicata
  misc_feature (11)..(11): Xaa can be any naturally occurring amino acid
MAAASVSLKSXLFLSSPLSDFGGAAISISAQNRRRSWQPRGARMQVAAAADSKNILIMGGTRFIGLFLSRKLVQEGHQVTLFTRGKAPITQQLPGESDAEYAEFSSKVLHLKGDRKDFDFVKTSLSAKGFDVVYDINGREATEVSPILEALPNLEQFIYCSSAGVYLKSDLLPHFETDAVDPKSRHKGKLETESLLETSGVNWTSIRPVYIYGPLNYNPVEEWFFHRLKAGRPIPIPNAGNQITQLGHVKDLATAFIKVLGNPKASKQVYNISGSKYVTFDGLARACAKAGGFPEPEIIHYNPKDFDFGKKKAFPFRDQHFFASVEKASKDLGVTPEYDLLDGLTDSYNLDFGRGTFRKEADFTTDDMILGKKLVSV

SEQ ID NO: 7022 - protein, 377 aa, Secale cereale
MAAASVSLKSSLFLSSPLSDFGGAAISISAQNRRRSWQPRGARMQVAAAADSKNILIMGGTRFIGLFLSRKLVQEGHQVTLFTRGKAPITQQLPGESDAEYAEFSSKVLHLKGDRKDFDFVKTSLSAKGFNVVYDINGREATEVSPILEALPNLEQFIYCSSAGVYLKSDLLPHFETDAVDPKSRHKGKLETESLLETSGVNWTSIRPVYIYGPLNYNPVEEWFFHRLKAGRPIPIPNAGNQITQLGHVKDLATAFIKVLGNPKASKQVYNISGSKYVTFDGLARACAKAGGFPEPEIIHYNPKDFDFGKKKAFPFRDQHFFASVEKASKDLEVTPEYDLLDGLTDSYNLDFGRGTFRKEADFTTDDMILGKKLVSV

SEQ ID NO: 7023 - protein, 377 aa, Secale cereale
MAAASVSLKSSLFLSSPLSDFGGAAISISAQNRRRSWQPRGARMQVAAAADSKNILIMGGTRFIGLFLSRKLVQEGHQVTLFTRGKAPITQQLPGESDAEYAEFSSKVLHLKGDRKDFDFVKTSLSAKGFNVVYDINGREATEVSPILEALPNLEQFIYCSSAGVYLKSDLLPHFETDAVDPKSRHKGKLETESLLETSGVNWTSIRPVYIYGPLNYNPVEEWFFHRLKAGRPIPIPNAGNQITQLGHVKDLATAFIKVLDNPKASKQVYNISGSKYVTFDGLARACAKAGGFPEPEIIHYNPKDFDFGKKKAFPFRDQHFFASVEKASKDLGVTPEYDLLDGLTDSYNLDFGRGTFRKEADFTTDDMILGKKLVSV

SEQ ID NO: 7024 - protein, 377 aa, Secale cereale
MAAASVSLKSSLFLSSPLSDFGGAAISISAQNRRRSWQPRGARMQVAAAADSKNILIMGGTRFIGLFLSRKLVQEGHQVTLFTRGKAPITQQLPCESDAEYAEFSSKVLHLKGDRKDFDFVKTSLSAKGFNVVYDINGREATEVSPILEALPNLEQFIYCSSAGVYLKSDLLPHFETDAVDPKSRHKGKLETESLLETSGVNWTSIRPVYIYGPLNYNPVEEWFFHRLKAGRPIPIPNAGNQITQLGHVKDLATAFIKVLDNPKASKQVYNISGSKYVTFDGLARACAKAGGFPEPEIIHYNPKDFDFGKKKAFPFRDQHFFASVEKASKDLGVTPEYDLLDGLTDSYNLDFGRGTFRKEADFTTDDMILGKKLVSV

SEQ ID NO: 7025 - protein, 334 aa, Secale cereale
MQVAAAADSKNILIMGGTRFIGLFLSRKLVQEGHQVTLFTRGKAPITQQLPGESDAEYAEFSSKVLHLKGDRKDFDFVKTSLSAKGFNVVYDINGREATEVSPILEALPNLEQFIYCSSAGVYLKSDLLPHFETDAVDPKSRHKGKLETESLLETSGVNWTSIRPVYIYGPLNYNPVEEWFFHRLKAGRPIPIPNAGNQITQLGHVKDLATAFIKVLGNPKASKQVYNISGSKYVTFDGLARACAKAGGFPEPEIIHYNPKDFDFGKKKAFPFRDQHFFASVEKASKDLGVTPEYDLLDGLTDSYNLDFGRGTFRKEADFTTDDMILGKKLVSV

SEQ ID NO: 7026 - protein, 258 aa, Secale cereale
MAAKGARMQVAAAADSKNILIMGGTRFIGLFLSRKLVQEGHQVTLFTRGKAPITQQLPGESDAEYAEFSSKVLHLKGDRKDFDFVKTSLSAKGFNVVYDINGREATEVSPILEALPNLEQFIYCSSAGVYLKSDLLPHFETDAVDPKSRHKGKLETESLLETSGVNWTSIRPVYIYGPLNYNPVEEWFFHRLKAGRPIPIPNAGNQITQLGHVKDLATAFIKVLGNPKASKAGVQHLRQQVRHLRRASTGMRKGWRVP

SEQ ID NO: 7027 - protein, 62 aa, Unknown
  Sequence found in Organisms: Zea mays, Pennisetum glaucum, Sorghum bicolor, Cenchrus ciliaris, Setaria italica, Triticum aestivum
MSKQGGKAKPLKAPKVDKKEYDESDLAYLQKKKDEEKALKELKAKAQKGAIGGSGLKKSGKK

SEQ ID NO: 7028 - protein, 62 aa, Eragrostis curvula
MSKQGGKAKPLKAPKTDKKEYDESDLAYLQKKKDEEKALKELKAKAQKGAIGGSGLKKSGKK

SEQ ID NO: 7029 - protein, 62 aa, Saccharum officinarum
MSKQGGKAKPLKAPKADKKEYDESDLAYLQKKKEEEKALKELKAKAQKGAIGGSGLKKSGKK

SEQ ID NO: 7030 - protein, 85 aa, Triticum aestivum
MSKQGGKAKPLKAPKADKKEYDETDLAYLQKKKDEEKALKELKAKAQKGAIGGSGLKKIGKEMRLAPSPIPKRMISTVYCVALTM

SEQ ID NO: 7031 - protein, 62 aa, Cynodon dactylon
MSKQGGKAKPLKAPKTEKKEYDESDLAYLQKKKDEEKALKELKAKAQKGAIGGSGLKKSGKK

SEQ ID NO: 7032 - protein, 62 aa, Panicum virgatum
MSKQGGKAKPLKAPKADKKEYDESDLAYLQKKKEEEKALKDLKAKAQKGAIGGSGLKKSGKK

SEQ ID NO: 7033 - protein, 63 aa, Oryza sativa
MSKQGGKAKPLKAPKAEKKEYDESDLAYLQKKKDEEKALKELKAKAGQKGALGGSGLKKSGKK

SEQ ID NO: 7034 - protein, 62 aa, Panicum virgatum
MSKQGGKAKPLKAPKVDKKEYDESDLAYLQKKKEEEKALKDLKAKAQKGAIGGSGLKKSGKK

SEQ ID NO: 7035 - protein, 62 aa, Fagopyrum esculentum
MSKQGGKLKPLKAPKTDKKEYDESDLAYLQKKKDEEKALKELKTKAQKGALGGSGLKKSGKK

SEQ ID NO: 7036 - protein, 62 aa, Cynodon dactylon
MSKQGGKAKPLKAPKTEKKDYDESDLAYLQKKKEEEKALKELKAKAQKGAIGGSGLKKSGKK

SEQ ID NO: 7037 - protein, 63 aa, Brachypodium distachyon
MSKQGGKAKPLKAPKAAEKDYDETDLAYLQKKKDEQKALKELKAKATQKGALGGSGLKKSGKK

SEQ ID NO: 7038 - protein, 64 aa, Bupleurum chinense
MSSKQGGKAKPLKAPKAEKKEYDEDDLAKLQKKKEEEKALKELKAKAQQKGAFGGSGLKKSGKK

SEQ ID NO: 7039 - protein, 64 aa, Eucalyptus grandis
MSSKQGGKAKPLKQPKADKKEYDENDLAYLQKKKEEEKALKELKAKATQKGSLGGSGLKKSGKK

SEQ ID NO: 7040 - protein, 64 aa, Ricinus communis
MSSKQGGKAKPLKQPKAGKKEYDETDLANIQKKKDEEKALKELKAKAAQKGALGGSGLKKSGKK

SEQ ID NO: 7041 - protein, 76 aa, Bupleurum chinense
PFTFEKTLTLILTCRPSKVEKLSLKAPKAEKKEYDEDDLAKLQKKKEEEKALKELKAKAQQKGAFGGSGLKKSGKK

SEQ ID NO: 7042 - protein, 63 aa, Vinca minor
MSSKQGGKAKPLKAPKADKKEYDEEDKAFLQKKKEEEKALKELKAKAQKGSIGGAGLKKSGKK

SEQ ID NO: 7043 - protein, 64 aa, Malus domestica
MSSKQGGKAKPLKAPKADKKEYDESDLANLQKKKEEEKALKELRAKAQQKGSFGGSGLKKSGKK

SEQ ID NO: 7044 - protein, 64 aa, Malus domestica
MSSKQGGKAKPLKAPKADKKEYDESDLANLQKKKDEEKALKELRAKAQQKGSFGGAGLKKSGKK

SEQ ID NO: 7045 - protein, 64 aa, Lippia dulcis
MSTKQGGKAKPLKQPKAEKKEYDETDKANIQKKKEEEKALKELKAKAQQKGAFGGSGLKKSGKK

SEQ ID NO: 7046 - protein, 64 aa, Unknown
  Sequence found in Organisms: Arabidopsis thaliana, Arabidopsis lyrata
MSSKQGGKAKPLKQPKADKKEYDETDLANIQKKKDEEKALKELRAKASQKGSFGGSGLKKSGKK

SEQ ID NO: 7047 - protein, 64 aa, Panax ginseng
MSSKQGGKAKPLKQPKAEKKEYDEDDLAKLQKKKEEEKALKELKAKAQQKGAFGGSGLKKSGKK

SEQ ID NO: 7048 - protein, 90 aa, Brassica napus
MSSKQGGKAKPLKQPKADKKEYDEHDMANLQKKKDEEKALKELRAKASQKGSFGGSGLKEERQEMIRFNHEACIRQCKFINLITDNRVFV

SEQ ID NO: 7049 - protein, 95 aa, Raphanus sativus
MASSSSSNNIEDIMDEQFDQFFDEKFDQLFDQRFENLFNRHDQHQTLGLEEPAMSSKQGGKAKPLKQPKADKKEYDEPIWPTFRRRKTRKRHLKN

SEQ ID NO: 7050 - protein, 63 aa, Vinca minor
MSSKQGGKAKPLKAPKADKKEYDEEDKAFLQKKKEEEKALKELKAKAAKGSIGGAGLKKSGKK

SEQ ID NO: 7051 - protein, 63 aa, Solanum melongena
MSSKQGGKAKPLKAPKADKKEYDENDKAFLAKKKEEEKALKELKAKAQKGSIGGTGLKKSGKK

SEQ ID NO: 7052 - protein, 63 aa, Unknown
  Sequence found in Organisms: Festuca arundinacea, Lolium multiflorum
MSKQGGKAKPLKQAKVAEKDYDETDLAYLQKKKDEQKALKELKAKAGQKGALGGSGLKKSGKK

SEQ ID NO: 7053 - protein, 63 aa, Ipomoea batatas
MSSKQGGKAKPLKQPKADKKEYDEADKAFLQKKKDEEKALKDLKAKAQKGALGGAGLKKSGKK

SEQ ID NO: 7054 - protein, 78 aa, Fraxinus spp
MSSKQGGKAKPLKQPKADKKEYDEDDKAFLQKKKEEEKALKELKNKGSKGSTWRCRAEEKWKEMKTCEELQETKNSFS

SEQ ID NO: 7055 - protein, 64 aa, Amorphophallus konjac
MSSKQGGKAKPLKQPKVEKKDYDEADLAYLQKKKDEEKALKDLKAKASQKGALGGSGLKKSGKK

SEQ ID NO: 7056 - protein, 64 aa, Unknown
  Sequence found in Organisms: Brassica napus, Brassica juncea, Brassica oleracea, Brassica rapa, Raphanus sativus, Eutrema parvulum
MSSKQGGKAKPLKQPKADKKEYDEHDMANLQKKKDEEKALKELRAKASQKGSFGGSGLKKSGKK

SEQ ID NO: 7057 - protein, 64 aa, Lippia dulcis
MSSKQGGKAKPLKQPKAEKKEYDETDKANIQKKKEEEKALKELKAKAQQKGAFGGSGLKKSGKK

SEQ ID NO: 7058 - protein, 64 aa, Unknown
  Sequence found in Organisms: Brassica napus, Brassica juncea
MSSKQGGKAKPLKQPKADKKEYDEHDVANLQKKKDEEKALKELRAKASQKGSFGGSGLKKSGKK

SEQ ID NO: 7059 - protein, 64 aa, Bruguiera gymnorhiza
MSSKQGGKAKPLKQPKADKKELDEVDKANLQKKKEEEKALKELKAKAQQKGAFGGSGLKKSGKK

SEQ ID NO: 7060 - protein, 64 aa, Coffea canephora
MSSKQGGKAKPLKQPKADKKEYDEEDKAHLQKKKEEEKALKELKAKAQKGALGGSGLKKSGGKK

SEQ ID NO: 7061 - protein, 64 aa, Vitis vinifera
MSSKAGGKLKPLKQPKADKKEYDEDDLAKLQKKKEEEKALKELKAKAAQKGAFGGSGLKKSGKK

SEQ ID NO: 7062 - protein, 64 aa, Salvia sclarea
MSSKQGGKAKPLKQPKAEKKEYDETDMANIQKKKEEEKALKELKAKAQQKGAFGGSGLKKSGKK

SEQ ID NO: 7063 - protein, 64 aa, Sesamum indicum
MSSKQGGKAKPLKQPKAEKKEYDEIDKANIQKKKDEEKALKELKAKAQQKGAFGGSGLKKSGKK

SEQ ID NO: 7064 - protein, 64 aa, Fragaria vesca
MSSKQGGKAKPLKQPKADKKEYDEDDLAKLQKKKDEEKALKELRAKASQKGSFGGAGLKKSGKK

SEQ ID NO: 7065 - protein, 64 aa, Camellia sinensis
MSSKQGGKAKPLKQPKADKKEYDESDLANIQKKKDEEKALRELRAKAQQKGAFGGSGLKKSGKK

SEQ ID NO: 7066 - protein, 64 aa, Triphysaria pusilla
MSSKQGGKAKPLKQPKADKKEYDEIDMANIQKKKDEEKALKELKAKAQQKGSFGGSGLKKSGKK

SEQ ID NO: 7067 - protein, 64 aa, Zostera marina
MSSKQGGKAKPLKQPKAKGKEYDETDLANLQKKKDEEKALKELKAKASQKGSFGGAGLKKSGKK

SEQ ID NO: 7068 - protein, 438 aa, Phalaenopsis aphrodite
MEELDSSSPTAEGRSVLHGRYELGRVLGQGTFAKVYVARNLRTGKNVAMKVVDKEKVIKVGMTEQVKREISVMKMVTHPNIVELHEVMATRSKIYFAMELVRGGELFSMIAQSGRLREDAARSYFRQLISAVDFCHSRGVYHRDLKPENLLLDEAGNLKIADFGLSAFADHVRADGLLHTTCGTPAYVAPEVIGNKGYDGAKADLWSCGVILYVLLAGSLPFKDDNIINMYRKIHRGDFKCPPWFSTDARSLVTKLLDPNPSTRITVANLIENPWFRKNPFPKPISEDPPAASAKKDGDEPERLNAFHLISLSEGFDLSPLFESRENMREEGMRFATKGPASGIVSRLEELAARVPGKLRVTKSSAAGVRLEGEERGRKGRLAVAAEIFAVAPSVLVVDVKMDGGDTLEYKRFCCNDLRPALKDIMWQSSEVQTTSAA

SEQ ID NO: 7069 - protein, 92 aa, Secale cereale
PTFRPTPVVAAPARVSRLRAPAPPPAPSAMSKQGGKAKPLKQAKVAEKDYDENDLAYLQKKKDEQKALKELKAKAGQKGALGGSGLKKSGKK

SEQ ID NO: 7070 - protein, 63 aa, Unknown
  Sequence found in Organisms: Euphorbia peplus, Euphorbia esula
MSSKQGGKAKPLKAPKAAKKEYDEDDLANIQKKKEEEKALKELRAKAQKGPIGGAGLKKSGKK

SEQ ID NO: 7071 - protein, 63 aa, Fraxinus spp
MSSKQGGKAKPLKAPKVDKKDYDEDDKAFLQKKKEEEKALKELKAKAQKGALGGAGLKKSGKK

SEQ ID NO: 7072 - protein, 63 aa, Fraxinus spp
MSSKQGGKAKPLKQPKADKKEYDEDDKAFLQKKKEEEKALKDLKAKAQKGALGGAGLKKSGKK

SEQ ID NO: 7073 - protein, 63 aa, Carpinus betulus
MSSKQGGKAKPLKQPKADKKEYDEIDMANIQKKKDEEKALKELRAKAQKGPIGGAGLKKSGKK

SEQ ID NO: 7074 - protein, 63 aa, Unknown
  Sequence found in Organisms: Hordeum vulgare, Setaria italica, Avena sativa, Secale cereale, Triticum aestivum
MSKQGGKAKPLKQAKVAEKDYDENDLAYLQKKKDEQKALKELKAKAGQKGALGGSGLKKSGKK

SEQ ID NO: 7075 - protein, 63 aa, Olea europaea
MSSKQGGKAKPLKQPKADKKEYDEDDKVFLQKKKEEEKALKELKAKAQKGALGGAGLKKSGKK

SEQ ID NO: 7076 - protein, 63 aa, Olea europaea
MSSKQGGKAKPLKQPKADKKEYDEDDKAFIQKKKEEEKALKELKAKAQKGALGGAGLKKSGKK

SEQ ID NO: 7077 - protein, 63 aa, Plantago ovata
MSSKQGGKAKPLKQPKAEKKEYDEIDKANIQKKKDEEKALKELKAKAQKGALGGAGLKKSGKK

SEQ ID NO: 7078 - protein, 63 aa, Primula obconica
MSTKQGGKAKPLKAPKVDKKEYDEVDKANIQKKKDEEKALKELRTKAQKGALGGAGLKKSGKK

SEQ ID NO: 7079 - protein, 63 aa, Antirrhinum majus
MSSKQGGKAKPLKAPKAEKKEYDEIDKANIQKKKEEEKALKELKAKAQKGALGGAGLKKSGKK

SEQ ID NO: 7080 - protein, 63 aa, Capsicum annuum
MSTKQGGKAKPLKAAKTEKKEYDETDKAFLAKKKEEEKALKELKAKAQKGSIGGAGLKKSGKK

SEQ ID NO: 7081 - protein, 63 aa, Juglans hindsii x Juglans regia
MSSKQGGKAKPLKQPKADKKEYDEVDKANIQKKKDEEKALKELRAKAQKGPIGGAGLKKSGKK

SEQ ID NO: 7082 - protein, 137 aa, Cirsium arvense
MASLIMAPQLFSVSKTNKPERKTSHSTNVRIRSMQRPLEEIYSIRVERNVSKERLAELEVSKWSTWKTGKCNVPWDWHVDQLVFIEEGEVRVVPEGSERHMSFVAGDLVRYPKWFEADLWFNDYYQERYSFRAYGDD

SEQ ID NO: 7083 - protein, 137 aa, Cirsium arvense
STLPSKLTVNFVLPYSSELSQTEVDMVIVPATTGQMGILPGHVPTIAELKPGVLSVHEGTDVKKYFISSGFAFVHSNSYADILAVEAVPLDRIDPAQVQKGLSEFTQKLSSASTELDKAEAQIGVDVHSALNSALTG

SEQ ID NO: 7084 - protein, 76 aa, Fraxinus spp
MSSKQGGKAKPLKAPKVDKKDYDEDDKAFLQKKKEEEKALKELKAKAQKGALGGAGLKKSGKNENLWRTTRPLLSL

SEQ ID NO: 7085 - protein, 73 aa, Carthamus tinctorius
FEQLLRIFSIMSSKQGGKAKPLKQPKADKKEYDEIDKANIQKKKEEEKALKELRAKAQKGALGGTGLKKSGKK

SEQ ID NO: 7086 - protein, 64 aa, Abies balsamea
MSTKQGGKAKPLKQPKKDKAEYDEADLAHIQKKKDEEKALKELKAKAAQKGSFGGTGLKKSGKK

SEQ ID NO: 7087 - protein, 64 aa, Amsonia hubrichtii
MSSKQGGKAKPLKQPKADKKEYFDEDKAFLQKKKDEEKALKELKAKAQQKGSFGGSGLKKSGKK

SEQ ID NO: 7088 - protein, 64 aa, Cicer arietinum
MSTKQGGKAKPLKKPKSDKKDYDEIDMANIQKKKDEEKALKELKAKAQQKGSFGGSGLKKSGKK

SEQ ID NO: 7089 - protein, 64 aa, Cucurbita pepo
MSSKQGGKAKPLKQPKVDKKEYDEVDLANKQKKKDEEKALRELKAKAQQKGAFGGAGLKKSGKK

SEQ ID NO: 7090 - protein, 64 aa, Distylium racemosum
MSSKQGGKAKPLKQPKQDKKEYDEVDLANIQKKKDEEKALKDLKAKAQQKGSFGGSGLKKSGKK

SEQ ID NO: 7091 - protein, 64 aa, Euonymus alatus
MSSKQGGKLKPLKQPKGDKKEYDEIDKANIQKKKDEEKALKELKAKAQQKGAFGGSGLKKSGKK

SEQ ID NO: 7092 - protein, 64 aa, Tropaeolum majus
MSSKQGGKAKPLKQPKADKKEYDEHDLANIQKKKDEEKALKELRSKAQQKGSFGGSGLKKSGKK

SEQ ID NO: 7093 - protein, 64 aa, Lippia dulcis
  misc_feature (14)..(14): Xaa can be any naturally occurring amino acid
MSSKQGGKAKPLKXPKADKKEYDETDMANIQKKKEEEKALKELRAKAQQKGSFGGSGLKKSGKK

SEQ ID NO: 7094 - protein, 64 aa, Unknown
  Sequence found in Organisms: Medicago truncatula, Trigonella foenum-graecum
MSTKQGGKAKPLKKPKSDKKDYDEVDMANIQKKKDEEKALKELKAKASQKGSFGGSGLKKSGKK

SEQ ID NO: 7095 - protein, 64 aa, Valeriana officinalis
MSSKQGGKAKPLKQPKADKKEYDEDDLAKLQKKKEEEKALKELRAKASQKGSFGGAGLKKSGKK

SEQ ID NO: 7096 - protein, 64 aa, Brassica juncea
MSSKQGGKAKPLKQPKADKKEYDEHDMANIQKKKDEEKALKELRAKASQKGSFGGSGLKKSGKK

SEQ ID NO: 7097 - protein, 64 aa, Ocimum basilicum
MSSKAGGKAKPLKQPKVAKKEYDEDDLAKLQKKKEEEKALKELKAKAQQKGAFGGSGLKKSGKK

SEQ ID NO: 7098 - protein, 64 aa, Ocimum basilicum
MSSKQGGKAKPLKQPKAEKKEYDEMDKANIQKKKEEEKALKELKAKAQQKGAFGGSGLKKSGKK

SEQ ID NO: 7099 - protein, 64 aa, Manihot esculenta
MSSKQGGKAKPLKQPKADKKEYDETDMANIQKKKEEEKALKELRAKATQKGTFGGSGLKKSGKK

SEQ ID NO: 7100 - protein, 64 aa, Unknown
  Sequence found in Organisms: Citrus sinensis, Citrus clementina, Citrus sinensis
MSSKQGGKAKPLKQPKADKKEYDEQDLANIQKKKEEEKALKELRAKAQQKGSFGGSGLKKSGKK

SEQ ID NO: 7101 - protein, 64 aa, Cycas rumphii
MSTKQGGKAKPLKQPKHEKKEYDESDLAHLQKKKDEEKALKDLKSKAAQKGALGGSGMKKSGKK

SEQ ID NO: 7102 - protein, 64 aa, Zingiber officinale
MSSKQGGKAKPLKQPKAEKKEYDETDLVNIQKKKDEEKALKELRAKASQKGTFGGSGLKKSGKK

SEQ ID NO: 7103 - protein, 64 aa, Mimulus guttatus
MSTKQGGKAKPLKQPKAEKKEYDEIDKANIQKKKDEEKAIKELKAKAQQKGAFGGAGLKKSGKK

SEQ ID NO: 7104 - protein, 64 aa, Raphanus sativus
MSSKQGGKAKPLKQPKTDKKEYDEHDMANLQKKKDEEKALKELRAKASQKGSFGGSGLKKSGKK

SEQ ID NO: 7105 - protein, 64 aa, Rosa hybrid cultivar
MSSKQGGKAKPLKQPKAEKKEYDEDDLAKLQKKKDEEKALKELRAKASQKGSFGGAGLKKSGKK

SEQ ID NO: 7106 - protein, 64 aa, Triphysaria pusilla
MSTKQGGKAKPLKQPKTEKKEYDEIDKANIQKKKDEEKALKELKAKAQQKGSFGGSGLKKSGKK

SEQ ID NO: 7107 - protein, 76 aa, Sarracenia psittacina
MSSKQGGKAKPLKQPKAERRNTTRVIWLTSRRRRTRKRHLGSLEPRLNRRDHLEVLASRKVGRNEGFKPKTTSELV

SEQ ID NO: 7108 - protein, 71 aa, Brassica juncea
MSSKQGGKAKPLKQPKADKKEYDEHDMANIQKKKDEEKALKELRAKASQKGSFGGSGLKKSGKMRKRHLKS

SEQ ID NO: 7109 - protein, 95 aa, Elaeis guineensis
SPRKGERRPPVSPLPPCSRVGLAPFSSDRTTMSSKQGGKAKPLKQPKVQKKEYDEADLANLQKKKEEEKAMKELKAKASQKGTFGGSGLKKSGKK

SEQ ID NO: 7110 - protein, 63 aa, Unknown
  Sequence found in Organisms: Ambrosia trifida, Gerbera hybrid cultivar, Carthamus tinctorius
MSSKQGGKAKPLKQPKAEKKEYDEIDKANIQKKKDEEKALKELRAKAQKGALGGTGLKKSGKK

SEQ ID NO: 7111 - protein, 63 aa, Fagus grandifolia
MSSKQGGKAKPLKQPKAEKKEYDEVDMANIQKKKDEEKALKELRAKAQKGPIGGTGLKKSGKK

SEQ ID NO: 7112 - protein, 63 aa, Unknown
  Sequence found in Organisms: Centaurea maculosa, Cirsium arvense, Cynara scolymus
MSSKQGGKAKPLKQPKAEKKEYDEMDKANLQKKKEEEKALKELRAKAQKGALGGAGLKKSGKK

SEQ ID NO: 7113 - protein, 63 aa, Plantago ovata
MSSKQGGKAKPLKQPKSEKKEYDEIDKANIQKKKDEEKALKELKAKAQKGALGGAGLKKSGKK

SEQ ID NO: 7114 - protein, 63 aa, Unknown
  Sequence found in Organisms: Cichorium intybus, Helianthus annuus, Tragopogon dubius
MSSKQGGKAKPLKQPKAEKKEYDEVDKANIQKKKDEEKALKELRAKAQKGALGGTGLKKSGKK

SEQ ID NO: 7115 - protein, 63 aa, Artemisia annua
MSSKMGGKAKPLKAPKAEKKEYDEVDKANIQKKKDEEKALKELRAKAQKGALGGAGLKKSGKK

SEQ ID NO: 7116 - protein, 61 aa, Lolium multiflorum
KQGGKAKPLKQAKVAEKDYDETDLAYLQKKKDEQKALKELKAKAGQKGALGGSGLKKSGKK

SEQ ID NO: 7117 - protein, 63 aa, Petunia hybrida
MSSKQGGKAKPLKAPKTEKKEYDDNDKAFLQKKKEEEKALKELKAKAQKGSIGGAGLKKSGKK

SEQ ID NO: 7118 - protein, 63 aa, Unknown
  Sequence found in Organisms: Solanum tuberosum, Solanum phureja
MSSKQGGKAKPLKAPKSEKKEYDENDKAFLAKKKEEEKALKELKAKAQKGSIGGAGLKKSGKK

SEQ ID NO: 7119 - protein, 63 aa, Solanum lycopersicum
MSSKQGGKAKPLKAPKTEKKEYDENDKAFLAKKKEEEKALKELKAKAQKGSIGGTGLKKSGKK

SEQ ID NO: 7120 - protein, 63 aa, Tragopogon dubius
MSSKQGGKAKPLKQPKAEKKEYDEVDKANIQKKKDEEKALKELRAKAQKGALGGAGLKKSGKK

SEQ ID NO: 7121 - protein, 63 aa, Triphysaria pusilla
MSKQGGKAKPLKQPKSDKKEYDEFDMANIQKKKEDEKALKELKAKAQQKGSFGGSGLKKSGKK

SEQ ID NO: 7122 - protein, 63 aa, Juglans hindsii x Juglans regia
MSSKQGGKAKPLKQPKSDKKEYDEVDLANLQKKKEEEKALKELRAKAQKGPVGGAGLKKSGKK

SEQ ID NO: 7123 - protein, 64 aa, Cannabis sativa
MSSKQGGKAKPLKQPKKDQKDYDETDLANIQKKKEEEKALKDLKAKAQQKGAFGGSGLKKSGKK

SEQ ID NO: 7124 - protein, 64 aa, Chelidonium majus
MSSKQGGKAKPLKAPKVEKKEYDEDDLAKLQKKKEEEKALKELRAKASQKGSFGGAGLKKSGKK

SEQ ID NO: 7125 - protein, 64 aa, Cicer arietinum
MSTKQGGKAKPLKKPKFDKKDYDEIDMANIQKKKDEEKALKELKAKAQQKGFFGGFGLKKSGKK

SEQ ID NO: 7126 - protein, 64 aa, Humulus lupulus
MSSKQGGKAKPLKQPKKDQKDYDETDLANIQKKKEEEKALRELKAKAQQKGAFGGSGLKKSGKK

SEQ ID NO: 7127 - protein, 64 aa, Elaeis guineensis
MSSKQGGKAKPLKQPKVQKKEYDEADLANLQKKKEEEKAMKELKAKASQKGTFGGSGLKKSGKK

SEQ ID NO: 7128 - protein, 64 aa, Platanus occidentalis
MSSKQGGKAKPLKQPKADKKEYDEIDMANIQKKKDEEKALKELRAKASQKGSFGGTGLKKSGKK

SEQ ID NO: 7129 - protein, 64 aa, Papaver somniferum
MSSKQGGKAKPLKQPKAQQKEYDETDLANLQKKKEEEKALKELRTKAQKGGALGGAGLKKSGKK

SEQ ID NO: 7130 - protein, 64 aa, Sarracenia psittacina
MSSKQGGKAKPLKQPKVDKKDYDENDLANLQKKKEEEKALKDLRAKAQQKGAFGGSGLKKSGKK

SEQ ID NO: 7131 - protein, 64 aa, Sarracenia psittacina
MSSKQGGKAKPLKQPKAEKKEYDESDLANLQKKKDEEKALRELRAKAQQKGSFGGAGLKKSGKK

SEQ ID NO: 7132 - protein, 64 aa, Picea glauca
MSSKQGGKAKPLKQPKKDKAEYDEADLAHIQKKKDEEKALKELKAKASQKGSFGGTGLKKSGKK

SEQ ID NO: 7133 - protein, 64 aa, Picea glauca
MSSKQGGKAKPLKQPKKDKAEYDEADLAHIQKKKDEEKALKELKAKAAQKGSFGGTGLKKSGKK

SEQ ID NO: 7134 - protein, 64 aa, Unknown
  Sequence found in Organisms: Brassica napus, Brassica juncea, Brassica oleracea, Thellungiella halophila, Eutrema halophilum
MSSKQGGKAKPLKQPKADKKEYDEHDMANIQKKKEEEKALKELRAKASQKGSFGGSGLKKSGKK

SEQ ID NO: 7135 - protein, 64 aa, Tripterygium wilfordii
MSSKQGGKLKPLKQPKGDKKEYDEIDIANIQKKKEEEKALKELKAKAQQKGAFGGSGLKKSGKK

SEQ ID NO: 7136 - protein, 64 aa, Utricularia gibba
MSSKQGGKAKPLKQPKVEKKEYDEIDKANIQKKKDEEKALKDLKAKAQQKGAFGGSGLKKSGKK

SEQ ID NO: 7137 - protein, 64 aa, Brassica juncea
MSSKQGGKATPLKQPKADKKEYDEHDMANIQKKKDEEKALKELRAKASQKGSFGGSGLKKSGKK

SEQ ID NO: 7138 - protein, 64 aa, Musa acuminata
MSSKQGGKLKPLKQPKSDKKEYDETDLANLQKKKDEEKAVKELRAKASQKGSFGGTGLKKSGKK

SEQ ID NO: 7139 - protein, 64 aa, Phaseolus coccineus
MSTKQGGKAKPLKKPKSDKKDYDDVDMANLQKKKEEEKALKELKAKAQQKGSFGGSGLKKSGKK

SEQ ID NO: 7140 - protein, 64 aa, Phaseolus coccineus
MSTKQGGKAKPLKKPKSDKKDYDDVDIANLQKKKEEEKALKELKAKAQQKGSFGGSGLKKSGKK

SEQ ID NO: 7141 - protein, 64 aa, Unknown
  Sequence found in Organisms: Glycine max, Vigna unguiculata, Arachis hypogaea
MSTKQGGKAKPLKKPKSDKKDYDEVDMANIQKKKEEEKALKELKAKAQQKGSFGGSGLKKSGKK

SEQ ID NO: 7142 - protein, 64 aa, Cryptomeria japonica
MSSKQGGKAKPLKQPKQEKKEYDEHDLANIQKKKDEEKALKELKTKAQQKGSFGGSGLKKSGKK

SEQ ID NO: 7143 - protein, 64 aa, Gnetum gnemon
MSSKQGGKVKPLKQPKQDKKEYDESDLAYLQKKKDEEKALKEMKSKATQKGAFSGAGLKKSGKK

SEQ ID NO: 7144 - protein, 64 aa, Heritiera littoralis
MSSKQGGKLKPLKQAKSDKKEYDEHDLANIQKKKEEEKALKELKAKAQQKGAFGGSGLKKSGKK

SEQ ID NO: 7145 - protein, 64 aa, Unknown
  Sequence found in Organisms: Glycyrrhiza uralensis, Cajanus cajan
MSTKQGGKAKPLKKPKSDKKDYDEIDMANIQKKKEEEKALKELKAKAQQKGSFGGSGLKKSGKK

SEQ ID NO: 7146 - protein, 64 aa, Pisum sativum
MSTKQGGKAKPLKKPKSDKKDYDEVDMANIHKKKDEEKALKELKAKASQKGSFGGSGLKKSGKK

SEQ ID NO: 7147 - protein, 64 aa, Podocarpus macrophillus
MSGKQGGKAKPLKQAKQEKKEYDEVDLANIQKKKDEEKALKELKSKAQQKGSFGGSGLKKSGKK

SEQ ID NO: 7148 - protein, 64 aa, Populus trichocarpa
MSSKLGGKAKPLKAPKSEKKDYDETDLANIQKKKDEEKALKELRAKAQQKGSFGGSGLKKSGKK

SEQ ID NO: 7149 - protein, 64 aa, Sciadopitys verticillata
MSSKQGGKAKPLKQPKQEKKEYDEVDLANIQKKKDEEKALRELKAKAQQKGSFGGSGLKKSGKK

SEQ ID NO: 7150 - protein, 64 aa, Glycine max
MSTKQGGKAKPLKKPKSDKKDYDEIDVANIQKKKEEEKALKELKAKAQQKGSFGGSGLKKSGKK

SEQ ID NO: 7151 - protein, 64 aa, Tamarix hispida
MSSKQGGKAKPLKQPKSDKKDYDETDKANLQKKKEEEKALKELRAKASQKGSFGGSGLKKSGKK

SEQ ID NO: 7152 - protein, 63 aa, Catharanthus roseus
MSSKQGGKAKPLKQPKAEKKDYDEVDKAFLQKKKEEEKALKDLKAKAQKGSIGGTGLKKSGKK

SEQ ID NO: 7153 - protein, 63 aa, Euphorbia peplus
MSSKQGGKAKPLKQPKTAKKEYDESDLANIQKKKEEEKALKELRAKAQKGPIGGAGLKKSGKK

SEQ ID NO: 7154 - protein, 63 aa, Unknown
  Sequence found in Organisms: Flaveria ramosissima, Helianthus annuus
MSSKQGGKAKPLKQPKAEKKEYDEIDKANIQKKKEEEKALKELRAKAQKGALGGTGLKKSGKK

SEQ ID NO: 7155 - protein, 63 aa, Flaveria ramosissima
MSSKQGGKAKPLKQPKAEKKEYDEIDKANIQKKKEEEKALKELRAKAQKGALGGAGLKKSGKK

SEQ ID NO: 7156 - protein, 63 aa, Linum usitatissimum
MSSKQGGKAKPLKQPKSDKKEYDDVDKAFLQKKKEEEKALKDLKAKAQKGAVGGAGLKKSGKK

SEQ ID NO: 7157 - protein, 63 aa, Olea europaea
MSSKQGGKAKPLKAPKSEKKEYDENDKAFIQKKKEEEKALKELKSKAQKGALGGAGLKKSGKK

SEQ ID NO: 7158 - protein, 63 aa, Cleome spinosa
MSSKQGGKLKPLKQPKGGKKEYDEHDLENLQKKKEEEKALKELRAKAQKGAIGGAGLKKSGKK

SEQ ID NO: 7159 - protein, 63 aa, Unknown
  Sequence found in Organisms: Taraxacum officinale, Lactuca sativa
MSSKQGGKAKPLKQPKSEKKEYDEVDKANIQKKKDEEKALKELRAKAQKGALGGTGLKKSGKK

SEQ ID NO: 7160 - protein, 63 aa, Quercus alba
MSSKQGGKAKPLKQPKADKKDYDEVDMANIQKKKEEEKALKELRAKAQKGPIGGAGLKKSGKK

SEQ ID NO: 7161 - protein, 63 aa, Unknown
  Sequence found in Organisms: Orobanche aegyptiaca, Nicotiana tabacum
MSSKQGGKAKPLKAPKSEKKEYDENDKAFLAKKKEEEKALKELKAKAAKGSIGGTGLKKSGKK

SEQ ID NO: 7162 - protein, 62 aa, Tamarix hispida
MPSKQGGKAKPLKQPKSDKEYDEIDRANLQKKKEEEKALKELRAKAQKGSLGGSGLKKSGKK

SEQ ID NO: 7163 - protein, 64 aa, Amborella trichopoda
MSSKQGGKAKPLKQPKAEKKDYDEDDLANIQKKKEEEKALKELRAKASQKGAFGGAGLKKSGKK

SEQ ID NO: 7164 - protein, 64 aa, Cedrus atlantica
MSSKQGGKAKPLKQPKKDKAEYDEADLAHIQKKKDEEKALKELKTKAAQKGSFGGTGLKKSGKK

SEQ ID NO: 7165 - protein, 64 aa, Cucurbita pepo
MSSKQGGKAKPLKQPKADKKEYDEVDMANMQKKKDEEKALRELRAKAQQKGTFGGAGLKKSGKK

SEQ ID NO: 7166 - protein, 64 aa, Euonymus alatus
MSSKQGGKAKPLKQPKSEKKEYDEIDKANIQKKKEEEKAIKELKAKAQQKGAFGGSGLKKSGKK

SEQ ID NO: 7167 - protein, 64 aa, Unknown
  Sequence found in Organisms: Gossypium hirsutum, Gossypium raimondii
MSSKQGGKAKPLKQPKAEKKEYDEHDLANIQKKKEEEKALRELRAKASQKGSFGGSGLKKSGKK

SEQ ID NO: 7168 - protein, 64 aa, Unknown
  Sequence found in Organisms: Pinus pinaster, Pinus taeda
MSSKQGGKAKPLKQPKKDKAEYDEADLAHIQKKKDEEKALKDLKAKAAQKGSFGGTGLKKSGKK

SEQ ID NO: 7169 - protein, 64 aa, Pinus pinaster
MSSKQGGKAKPLKQPKKDKAEYDEADLAHIQKKKDEEKALKELKTKASQKGSFGGTGLKKSGKK

SEQ ID NO: 7170 - protein, 64 aa, Lippia dulcis
MSSKQGGKAKPLKQPKSEKKEYDEIDKANIQKKKEEEKALKELKAKAQQKGSFGGSGLKKSGKK

SEQ ID NO: 7171 - protein, 64 aa, Sarracenia psittacina
MSSKQGGKAKPLKQPKVDKKDYDENDLANLQKKKEEEKALRDLRAKAQQKGAFGGSGLKKSGKK

SEQ ID NO: 7172 - protein, 64 aa, Scabiosa columbaria
MSSKQGGKAKPLKQPKADKKEYDEDDLAKLAKKKEEEKALKELRNKAQQKGSFGGAGLKKSGKK

SEQ ID NO: 7173 - protein, 76 aa, Picea glauca
MSSKQGGKAKPLKQPKKDKAEYDEADLAHIQKKKDEEKALKELKAKASQKGSFGGTGLKKSGKSSLPLTAFSTSCH

SEQ ID NO: 7174 - protein, 64 aa, Thalictrum flavum
MSSKQGGKAKPLKQPKSEKKEYDENDLANLQKKKEEEKALKELRAKASQKGSFGGTGLKKSGKK

SEQ ID NO: 7175 - protein, 64 aa, Musa acuminata
MSSKQGGKLKPLKQPKADKKEYDEMDKANIQKKKDEEKALKELRAKASQKGSFGGTGLKKSGKK

SEQ ID NO: 7176 - protein, 64 aa, Musa acuminata
MSSKQGGKLKPLKQPKSEKKEYDEADLANLQKKKDEEKALKELRAKASQKGSFGGTGLKKSGKK

SEQ ID NO: 7177 - protein, 64 aa, Hevea brasiliensis
MSSKQGGKAKPLKQPKAEKKDYDETDTANIQKKKEEEKALKELRAKAAQKGTFGGSGLKKSGKK

SEQ ID NO: 7178 - protein, 64 aa, Mesembryanthemum crystallinum
MSSKQGGKAKPLKAPKKDAKDYDEVDMANMQKKKEEEKALRELKAKAQQKGAFGGSGLKKSGKK

SEQ ID NO: 7179 - protein, 64 aa, Jatropha curcas
MSSKQGGKAKPLKQPKSDKKEYDENDLANIQKKKEEEKALRELRAKASQKGAFGGTGLKKSGKK

SEQ ID NO: 7180 - protein, 64 aa, Liriodendron tulipifera
MSSKQGGKAKPLKQPKAEKKDYDENDLANIQKKKDEEKALKEMRAKASQKGAFGGTGLKKSGKK

SEQ ID NO: 7181 - protein, 64 aa, Lotus japonicus
MSSKQGGKAKPLKKPKSDKKDYDEVDMANIQKKKEEEKALKELKAKASQKGSFGGSGLKKSGKK

SEQ ID NO: 7182 - protein, 64 aa, Mimulus guttatus
MSSKQGGKAKPLKQPKAASKEYDEVDMANIQKKKEEEKALKELKAKAQQKGSFGGSGLKKSGKK

SEQ ID NO: 7183 - protein, 65 aa, Orobanche aegyptiaca
MSTGKQGGKAKPLKQPKSDKKEYDEFDKANIQKKKDEEKALKELKEKAKQKGSFGGSGLKKSGKK

SEQ ID NO: 7184 - protein, 64 aa, Ananas comosus
MSSRQGGKLKPLKQAKADKKEYDETDLANIQKKKDEEKALKELRAKASQKGSFGGAGLKKSGKK

SEQ ID NO: 7185 - protein, 64 aa, Pinus taeda
MSSKQGGKAKPLKQPKKDKAEYDEADLAHIQKKKDEEKALKELKTKASQKGSFGGAGLKKSGKK

SEQ ID NO: 7186 - protein, 64 aa, Prunus persica
MSSKQGGKAKPLKQPKSEKKEYDESDLANIQKKKDEEKALKELRAKAQQKGSFGGAGLKKSGKK

SEQ ID NO: 7187 - protein, 64 aa, Pseudotsuga menziesii
MSSKQGGKAKPLKQPKKDKAEYDEADLAHIQKKKDEEKALKELKSKAAQKGSFGGTGLKKSGKK

SEQ ID NO: 7188 - protein, 66 aa, Salvia sclarea
TRPWLSLRGKAKPLKQPKAEKKEYDETDMANIQKKKEEEKALKELKAKAQQKGAFGGSGLKKSGKK

SEQ ID NO: 7189 - protein, 98 aa, Triticum aestivum
HFPSPFPTFRPPPVVAGPARVFWPRRSGPPPGPFKKSKGGGKAKPLKQAKVAEKDYDEDDLAYLQKKKDEPKALKELKAKAGQKGALGGSGLKKSGKK

SEQ ID NO: 7190 - protein, 63 aa, Linum usitatissimum
MFFKQGGKAKPLKQPKLDKKEYDDVDKAFLQKKKEEEKALKDLKAKAQKGAVGGAGLKKSGKK

SEQ ID NO: 7191 - protein, 63 aa, Linum usitatissimum
MFFKQGGKAKPLKQPKSDKKEYDDVDKAFLQKKKEEEKALKDLKAKAQKGAVGGAGLKKSGKK

SEQ ID NO: 7192 - protein, 63 aa, Castanea mollissima
MSSKQGGKAKPLKQPKAEKKDYDEVDMANIQKKKEEEKALKELRAKAQKGPIGGAGLKKSGKK

SEQ ID NO: 7193 - protein, 67 aa, Cichorium intybus
ARALVPNSARGSVAHLYGSEQTLTLDPIMSSKQGGKAKPLKQPKAEKKEYDEVDKATFKRRRMRKRP

SEQ ID NO: 7194 - protein, 63 aa, Cleome gynandra
MSSKQGGKLKPLKQPKGSKKEYDEHDLENIQKKKEEEKALKELRAKAQKGAIGGAGLKKSGKK

SEQ ID NO: 7195 - protein, 65 aa, Orobanche aegyptiaca
MSTGKQGGKAKPLKQPKSDKKEYDEFDKANIQKKKDEEKALKELKAKAQQKGSFGGSGLKKSGKK

SEQ ID NO: 7196 - protein, 65 aa, Physcomitrella patens
MSGRQGGKLKPLKAPKGKEKEYDETDLANLQKKKDEEKALKELKAKAAGKGAFGGAGLKKSGGKK

SEQ ID NO: 7197 - protein, 248 aa, Saccharum officinarum
MAVEGTPGQLAFVEESKLKKRKENVDWAVRNRERKAAKRQRIRDEHKVIVKRPEDFVTAFRNKERDFLRMRTRLKVRKQPPAEALSSKLIFAIRIPGSVDLHPHIRKVLRKLRLTKVLTGVFLKATELTLKRLLVVEPFVTYGFPNLKNVKELIYKKGRGFLDKEPFPLTSNDLIEKALGEHGIICLEDVVHEIATVGPHFREASKFLMPFKLKCPERRLQMKRKPYKDGGDSGNRGDKINELIEKLN

SEQ ID NO: 7198 - protein, 248 aa, Sorghum bicolor
MAVEGTPEQLAFVQESKLQKRKENVDWAVRNRERKAAKRQRIRDEHKVVVKRPEDFVTAFRNKERDFLRMRTRLKVRKQPPVEALSSKLVFAIRIPGSVDLHPNIRKVLRKLRLTRVLTGVFLKATALTLKRLLIVEPFVTYGFPNLKNVKELIYKKGRGFLDKEPFPLTSNDLIEKALGDHGIICLEDVVHEIATVGPHFRDASRFLMPFMLKCPERRLQMKRKPYKDGGDSGNRGDKINELIEKLN

SEQ ID NO: 7199 - protein, 248 aa, Zea mays
MAVEGTPNQLAFVEESKLQKRKENVDWAVRNRERRAAKRQRIRDEHKVAVRRPEEFVTAFRNKERDFLRMRTRIKVRSQPPVEALGSRLVFAIRIPGSVDLHPHIRKVLRKLRLTKVLTGVFLRATELTLKRLLVVEPFVTYGFPNLKSVKELIYKKGRGFFDMEPFPLTSNDLIEKALGDHGIICLEDLVYEIATVGPHFREASRFLMPFQLKCPERRLQMKRKPYRDGGDSGNRGDKVNELIEKLN

SEQ ID NO: 7200 - protein, 262 aa, Setaria italica
MASGGDEASRTVPPLALGGTTEELAFVKETVLKKRKENADWAVRNRERKAAKRQRIRAENKVVVKRPEEFVTAFRNKERDFLRMRTRLKVRKQPSVEALSSKLIFAIRIPGSVDLHPHIRKKLRKLRLTKVLTGVFLKATELTLKMLLEVEPFVTYGFPNLKNVKELIYKKGRGFVDKEPFPLTSNDLIEKALGDNGIICLEDLVHEIATVGPHFRDATKFLMPFKLKCPERRLQMKKKPYKDGGDSGDRGDKINELIEKLN

SEQ ID NO: 7201 - protein, 245 aa, Pennisetum glaucum
GGTREELAFVKETVLKKRKENADWALRNRERKAAKRQRIRAENKVIVKRPEDFVAAFRNKERDFLRMRTRLKVRKQPPVEAFSSKLIFAIRIPGSVDLHPHMRTKLRKLRLTKVLTGVFLKATELTLKMLLEVEPFVTYGFPNLKNVKDLIYKKGRGFLDKEPFPLTSNDLIEKALGDHGIICLEDLVHEIATVGPHFRDASRFLMPFKLKCPERRLQMKKKPYKDGGDSGDRGDKINELIEKLN

SEQ ID NO: 7202 - protein, 185 aa, Unknown
  Sequence found in Organisms: Sorghum bicolor, Saccharum officinarum
MPPAPKSGDALFASVDRVNAELFTLTYGAIVRQLLTDLEEVEEVNKQLDQMGYNIGTRLVDEFLAKSNVSRCVDFKETADVIAKLGFKMFLGVTATVTNWDAEGTSCSLVLEDNPLVDFVELPDTCQGLQYCNLLSGVIRGALEMVSMKTEVTWVRDMLRGDDAYEMRVKLIKQVPEEYPYKDDD

SEQ ID NO: 7203 - protein, 185 aa, Zea mays
MPPAPKSGDALFASVDRVNAELFTLTYGAIVRQLLTDLEEVEEVNKQLDQMGYNIGTRLVDEFLAKSNVSRCVDFKETADVIAKLGFKMFLGVTATVTNWDVEGTSCSIVLEDNPLVDFVELPDTCQGLQYCNLLSGVIRGALEMVSMKTEVTWVRDMLRGDDAYEMRVKLIKQVPEEYPYKDDD

SEQ ID NO: 7204 - protein, 187 aa, Setaria italica
MPPLTAPKSGDALFASVDRVNAELFTLTYGAIVRQLLTDLEEVEEVNKQLDQMGYNIGTRLVDEFLAKSNVSRCVDFKETADVIAKLGFKMFLGVTATVTNWDAEGTSCSFVLEDNPLVDFVELPDTCQGLQYCNVLSGVIRGALEMVSMKTEVTWVRDMLRGDDAYEMRVKLIKQVPEEYPYKDDD

SEQ ID NO: 7205 - protein, 187 aa, Panicum virgatum
MAPLTAPKSGDALFASVDRVNAELFTLTYGAIVRQLLTDLEEVEEVNKQLDQMGYNIGTRLVDEFLAKSNVSRCVDFKETADVIAKIGFKMFLGVTATVTNWDAEGTSCSFILEDNPLVDFVELPDTCQGLQYCNVLSGVIRGALEMVSMKTEVTWVRDMLRGDDAYEMRVKLIKQVPEEYPYKDDD

SEQ ID NO: 7206 - protein, 187 aa, Oryza sativa
MPPLTGPKSGDALFGSVERVNAELFTLTYGAIVRQLLTDLEEVEEVNKQLDQMGYNIGTRLVDEFLAKSNVSRCVDFKETADVIAKLGFKMFLGVTATVTNWDAEGTSCSFVLEDNPLVDFVELPDTCQGLQYCNVLSGVIRGALEMVSMKTEVTWVRDMLRGDDAYEMRVKLTKQVPEEYPYKDDD

SEQ ID NO: 7207 - protein, 979 aa, Brachypodium distachyon
MPPLTPPKSGDALFSSVERVNAELFTLTYGAIVRQLLTDLEEVEEVNKQLDQMGYNIGTRLVDEFLAKSNVSRCVDFKETADTIAKLGFKMFLGVTATVTNWDAEGTTCSFVLEDNPLVDFVELPDTCQGLQYCNVLSGVIRGALEMVSMKTEVTWVRDMLRGDDAYEMRVKLTKQVPEEYPYKDDDYTINGRESVSLVREPLNRYDANAIAAHNRRGEKVGHVDRDTARVLAHLLDTRLVAATHAIVPKHPSGKNRPKPFKLPCQVHLFAHPASADAVRSAVSGSGLSLIDTGHAEFSFSESAIVQEQTKKSDRDVDRLFARVVKEGEGRIKPMEAPEDVVVSDLFEHQKDALGWLVHREESCDLPPFWEEDKDGGYQNVLTSQKTKERPLPLKGGIFADDMGLGKTLTLLSLIARSKARNVVAKKGKGTKRRKVDDAGQESRTTLVVCPPSVFSSWVTQLEEHTEAGSLKVYMYHGERTKDKKELLKYDIVITTYSILGIEFGQEGSPVNDIEWFRVILDEAHVIKNSAARQTKAVIALNAQRRWVVTGTPIQNSSFDLYPLMAFLKFEPFSIKSYWQSLIQSPLVKGDKAGLSRLQNLLGAISLRRTKETESGSKSLVNIPPKTVVACYIELSSEEREYYDQMELEGRNKMLEFGAGDSIMRNYSTVLYFILRLRQLCNDVALCPLDMKAWLPGSSLEDVSKNPELLKKLASLVDDGDDFDCPICLSPPSKTVITSCTHIYCQTCILKILKSSSSRCPICRHALSKEDLFIAPEVQHPDEDGSGNLGSDKPLSSKVQALLELLKRSQKEDPLSKSVVFSQFRRMLILLEGPLKRAGFNILRLDGSMSAKKRSDVIKRFAMVGPDTPTVLLASLKAAGAGINLTAASTVYLFDPWWNPGVEEQAMDRVHRIGQKKAVKVVRLLVKGSIEERILELQERKKRLISGAFGRKGGAKENKEMRLEELRLMMGISSPAWGR

SEQ ID NO: 7208 - protein, 187 aa, Brachypodium distachyon
MPPLTPPKSGDALFSSVERVNAELFTLTYGAIVRQLLTDLEEVEEVNKQLDQMGYNIGTRLVDEFLAKSNVSRCVDFKETADTIAKLGFKMFLGVTATVTNWDAEGTTCSFVLEDNPLVDFVELPDTCQGLQYCNVLSGVIRGALEMVSMKTEVTWVRDMLRGDDAYEMRVKLTKQVPEEYPYKDDD

SEQ ID NO: 7209 - protein, 187 aa, Avena sativa
MPPLTTPKSGDALFANVDRVNAELFTLTYGAIVRQLLTDLEEVEEVNKQLDQMGYNIGTRLVDEFLAKSNVSGCVDFKETADTIAKLGFKMFLGVTATVTNWDAEGTTCSFVLEDNPLVDFVELPDTCQGLQYCNVLSGVIRGALEMVSMKTEVTWVRDMLRGDDAYEMRVKLTKQVPEEYPYKDDD

SEQ ID NO: 7210 - protein, 187 aa, Unknown
  Sequence found in Organisms: Hordeum vulgare, Secale cereale
MPPLTTPKSGDALFASVERVNAELFTLTYGAIVRQLLTDLEEVEEVNKQLDQMGYNIGTRLVDEFLAKSNVSNCADFKETADTIAKLGFKMFLGVTATVTNWDAEGTTCSFVLEDNPLVDFVELPDTCQGLQYCNVLSGVIRGALEMVSMKTEVTWVRDMLRGDDAYEMRVKLTKQVPEEYPYKDDD

SEQ ID NO: 7211 - protein, 185 aa, Triticum aestivum
PLTTPKSGDALFASVERVNAELFTLTYGAIVRQLLTDLEEVEEVNKQLDQMGYNIGTRLVDEFLAKSNVSNCADFKETADTIAKLGFKMFLGVTATVTNWDAEGTTCSFVLEDNPLVDFVELPDTCQGLQYCNVLSGVIRGALEMVSMKTEVTWVRDMLRGDDAYEMRVKLTKQVPEEYPYKDDD

SEQ ID NO: 7212 - protein, 180 aa, Pseudoroegneria spicata
  misc_feature (10)..(11): Xaa can be any naturally occurring amino acid
KSGDALFASXXRVNAELFTLTYGAIVRQLLTDLEEVEEVNKQLDQMGYNIGTRLVDEFLAKSNVSNCADFKETADTIAKLGFKMFLGVTATVTNWDAEGTTCSFVLEDNPLVDFVELPDTCQGLQYCNVLSGVIRGALEMVSMKTEVTWVRDMLRGDDAYEMRVKLTKQVPEEYPYKDDD

SEQ ID NO: 7213 - protein, 186 aa, Coffea canephora
MPPVAPRSGDAIFASVERVNAELFTLTYGAIVRQLLTDLEEVEEVNKQLDQMGYNIGIRLIDEFLAKSNVSRCVDFKETAEVIAKVGFKMFLGVTATVTNWDAEGTTCSLVLEDNPLVDFVELPDTCQGLYYCNVLSGVIRGALEMVSMKTEVTWIRDMLRGDDAFEMQVKLVKQVPEEYPYKDDE

SEQ ID NO: 7214 - protein, 186 aa, Catharanthus roseus
MAPVAPRSGDAIFASVERVNAELFTLTYGAIVRQLLTDLEEVEEVNKQLDQMGYNIGIRLIDEFLAKSNVSRCVDFKETAEVIAKVGFKMFLGVTATVTNWDAEGTTCSLILEDNPLVDFVELPDTCQGLYYCNILSGVIRGALEMVSMKTEVTWIRDMLRGDDAYEMQVKLLKQVPEEYPYKDDE

SEQ ID NO: 7215 - protein, 186 aa, Tabernaemontana elegans
MAPVAPRSGDAIFASVERVNAELFTLTYGAIVRQLLTDLEEVEEVNKQLDQMGYNIGIRLIDEFLAKSNVSRCVDFKETAEVIAKVGFKMFLGVTATVTNWDAEGTTCSLILEDNPLVDFVELPDTCQGLYYCNILSGVIRGALEMVSMKTEVTWLRDMLRGDDAYEMQVKLLKQVPEEYPYKDDE

SEQ ID NO: 7216 - protein, 180 aa, Avena sativa
RGDGPSFASVERVNAELFTLTYGAIVRQLITDLEEVEEVNKQLDQMGYNIGTRLVDEFLAKSNVSNCVDFKETADTIAKLGFKMFLGVTATVTNWDAEGTTCSFVLEDNPLVDFVELPDTCQGLHYCNVLSGVIRGALEMVSMKTEVTWVRDMLRGDDAYEMRVKLTKQVPEEYPYKDDD

SEQ ID NO: 7217 - protein, 186 aa, Elaeis guineensis
MAPLAPRTGDAVFASVERVNAELFTLTYGAIVRQLLTDLEEVEEVNKQLDQMGYNIGVRLIDEFLAKSGVSRCVDFRETADVIAKVGFKMFLGVTASVTNWDAEGTSCSLVLDDNPLVDFVELPDTCQGLYYCNILSGVIRGALEMVSMKTEVTWVRDMLHGDDAYELRVKLLKQVPEEYPYKDDE

SEQ ID NO: 7218 - protein, 186 aa, Antirrhinum majus
MAPAIPKSGDAIFASVDRVNAELFTLTYGAIVRQLLTDLEEVEEVNKQLDQMGYNIGVRLVDEFLAKSNVSRCVDFRETAEVIAKVGFKMFLGVTASVTNWDAEGTTCSLILEDNPLVDFVELPDTCQGLYYCNILSGVVRGALEMVSMKTEVTWLRDMLRGDDVFELQVKLLKQVPEEYPYKDDE

SEQ ID NO: 7219 - protein, 181 aa, Nuphar advena
PRSGDAVFASVERVNAELFTLTYGAIVRQLLTDLEETEEVNKQLDQMGYNIGIRLIDEFLAKSNVSRCVDFKETAEVIAKVGFKMFLGVTATVTNWDAEGTSCSLVLEDNPLVDFVELPDTCQGLYYCNILSGVVRGALEMVSLKTEVTWVRDMLHGDDAYELRVKLLKQVPEEYPYKDDE

SEQ ID NO: 7220 - protein, 174 aa, Avena sativa
FASVERVNAELFTLTYGAIVRQLITDLEEVEEVNKQLDQMGYNIGTRLVDEFLAKSNVSNCVDFKETADTIAKLGFKMFLGVTATVTNWDAEGTTCSFVLEDNPLVDFVELPDTCQGLHYCNVLSGVIRGALEMVSMKTEVTWVRDMLRGDDAYEMRVKLTKQVPEEYPYKDDD

SEQ ID NO: 7221 - protein, 186 aa, Olea europaea
MPPVAPRSGDAIFASVERVNAELFTLTYGAMVRQLLTDLEEVEEVNKQLDQMGYNIGVRLVDEFLAKSNVSRCVDFKETAEVIAKVGFKMFLGVTASVSNWDAEGTTCSIILEDNPLVDFVELPDTCQGLYYCNILSGVIRGALEMVSMKTEVTWLRDMLRGDDAFELQVKLLKQVPEEYPYKDDE

SEQ ID NO: 7222 - protein, 186 aa, Papaver somniferum
MAPLVPRSGDAIFANVERVNAELFTLTYGAMVRQLLTDLEEVEEVNKQLDQMGYNIGIRLIDEFLAKSNVSRCVDFKESADVIAKVGFKMFLGITATVTNWDADGTSCSLILEDNPLVDFVELPDTCQGLYYCNVLSGVIRGALEMVSMKTEVTWVRDMLRGDDAYELRVKLLKQVPEEYPYKDDE

SEQ ID NO: 7223 - protein, 186 aa, Aquilegia formosa
MAPLAPRTGDAVFANVERVNAELFTLTYGAIVRQLLTDLEEVEEVNKQLDQMGYNIGIRLIDEFLAKSNVSRCVDFKETADVIAKVGLKMFLGVTASVTNWDVDGTSCSLVLEDNPLVDFVELPDTCQGLYYCNILSGVIRGALEMVSMKTEVTWVRDMLRGDDAYELRLKLLKQVPEEYPYKDDE

SEQ ID NO: 7224 - protein, 186 aa, Aristolochia fimbriata
MAPVAPRTGDAVFANVERVNAELFTLTYGAIVRQLLTDLEEVEEVNKQLDQMGYNIGIRLIDEFLAKSNVTRCVDFKETAEVIAKVGFKMFLGVTASVTNWDADGTSCSLVLEDNPLVDFVELPDTCQGLYYCNILSGVIRGALEMVSMKTEVTWIRDMLRGDDAYELRVKLLKQVPEEYPYKDDE

SEQ ID NO: 7225 - protein, 186 aa, Musa acuminata
MAPLAPKTGDAVFASVDRVNAELFTLTYGAMVRQLLTDLEEVDEVNKQLDQMGYNIGVRLIDEFLAKSNVSRCVDFKETADVIAKVGFKMFLGITASVTSWDAEGTSFSLVLEDNPLVDFVELPDTCQGLHYCNILSGVLRGALEMVSMKTEVTWVRDMLHGDDAYELRVKLLKQVPEEYPYKDDE

SEQ ID NO: 7226 - protein, 186 aa, Orobanche aegyptiaca
MAPAAPKSGDAIFASVDRVNAELFTLTYGAIVRQLLTDLEEVEEVNKQLDQMGYNIGVRLVDEFLAKSNVSRCVDFRETAEVIAKVGFKMFLGVTASVTNWDAEGTTCSLILEDNPLVDFVELPDTCQGLQYCNILSGVVRGALEMVSMKTEVTWQRDMLKGDDVFELQVKLLKQVPEEYPYKDDE

SEQ ID NO: 7227 - protein, 177 aa, Secale cereale
MPPLTTPKSGDALFASVERVNAELFTLTYGAIVRQLLTDLEEVEEVNKQLDQMGYNIGTRLVDEFLAKSNVSNCADFKETADTIAKLGFKMFLGVTATVTNWDAEGTTCSFVLEDNPLVDFVELPDTCQGLQYCNVLSGVIRGALEMVSMKTEVTWVRDMLRGDDAYEMRVKLTKQV

SEQ ID NO: 7228 - protein, 189 aa, Vinca minor
MAPIAHVAPRSGDSIFASVERVNAELFTLTYGAIVRQLLTDLEEVEEVNKQLDQMGYNIGIRLIDEFLAKSNVSRCVDFKETAEVIAKVGFKMFLGVTATVTNWDVEGTTCSLILEDNPLVDFVELPDTCQGLYYCNILSGVIRGALEMVSMKTEVTWLRDMLRGDDAYEMQVKLLKQVPEEYPYKDDE

SEQ ID NO: 7229 - protein, 186 aa, Chelidonium majus
MAPVAPRSGDAVFANVERVNAELFTLTYGAMVRQLLTDLEEVEEVNKQLDQMGYNIGIRLIDEFLAKSNVSRCVDFKESADVIAKVGFKMFLGVTAAVTNWDADGTGFSLVLEDNPLVDFVELPDTCQGLYYCNVLSGVIRGALEMVSMKTEVTWVRDMLRGDDAYELRVKLLKQIPEEYPYKDDE

SEQ ID NO: 7230 - protein, 186 aa, Unknown
  Sequence found in Organisms: Gossypium hirsutum, Gossypium raimondii
MPPAAPRSGDAIFASVERVNAELFTLTYGAIVRQLLTDLEEVEEVNKQLDQMGYNIGIRLIDEFLAKSNVSRCVDFKETAEMIAKVGFKMFLGVTASVMNWDADGTCCSIVLEDNPLVDFVELPDTCQGLYYCNILSGVIRGALEMVAMKTEVTWIRDMLRGDDAYELQVKLLKQVPEEYPYKDDE

SEQ ID NO: 7231 - protein, 186 aa, Humulus lupulus
MAPVAPRSGDAIFASVDRVNAELFTLTYGAIVRQLLTDLEEVEEVNKQLDQMGYNIGIRLVDEFLAKSNVSSCVDFKETAEVIAKVGFKMFLGVTASVTNWNADGTSCSIVLEDNPLVDFVELPDTCQGLYYCNILSGVIRGALEMVSMKTEITWVRDMLRGDDAFELQVKLLKQIPEEYPYKDDE

SEQ ID NO: 7232 - protein, 186 aa, Citrullus lanatus
MPPAGPRSGDAIFASVERVNAELFTLTYGATVRQLLTDLEEVEEVNKQLDQMGYNIGIRLIDEFLAKSNISRCVDFKETADVIAKVGLKMFLGVNATVTNWDAEGTCCSIVLEDNPLVDFVELPDTCQGLHYCNILSGVIRGALEMVSMKTEVTWLRDMLRGDDSFELQVKLLKQVPEEYPYKDDE

SEQ ID NO: 7233 - protein, 186 aa, Theobroma cacao
MAPAAPRSGDAIFASVERVNAELFTLTYGAIVRQLLTDLEEVEEVNKQLDQMGYNIGIRLIDEFLAKSNVSRCVDFKETAEVIAKVGFKMFLGVTASVTNWDADGTCCSIVLEDNPLVDFVELPDTCQGLYYCNILSGVIRGSLEMVSMKTEVTWIRDMLRGDDAYELQVKLLKQVPEEYPYKDDE

SEQ ID NO: 7234 - protein, 186 aa, Zingiber officinale
  misc_feature (43)..(43): Xaa can be any naturally occurring amino acid
  misc_feature (140)..(140): Xaa can be any naturally occurring amino acid
MAPLAPKTGDAVFASIDHVNAELFTLTYGAMVRQLLTDLEEVXEVNKQLDQMGYNIGVRLIDEFLAKSNVSRCVDFKETADVIAKVGFKMFLGVTASVTNWDAEGTSFSLVLEDNPLVDFVELPDTFQGLHYCNILSGVXRGALEMVSMKTEVTWVRDMLHGDDAYELRVKLLKQVPEEYPYKDDE

SEQ ID NO: 7235 - protein, 186 aa, Vitis vinifera
MAPAAPRSGDAIFANVERVNAELFTLTYGAIVRQLLTDLEEVEEVNKQLDQMGYNIGIRLIDEFLAKSNVSRCVDFKETAEAIAKVGFKMFLGVTASVTNWDADGTSCSLVLEDNPLVDFVELPDTCQGLYYCNILSGVVRGALEMVSMKTEVTWIRDMLRGDDAYELQVKLLKQVPEEYPYKDDE

SEQ ID NO: 7236 - protein, 187 aa, Euphorbia peplus
MPAAAGPRSGDAIFASVERVNAELFTLTYGAIVRQLLTDLEEVEEVNKQLDQMGYNIGIRLVDEFLAKSNVTRCVDFKETCEVIAKVGFKMFLGVSASVTNWDAEGTCCSIILEDNPLVEFVELPDTCQGLYYCNVLSGVIRGALEMVSMKTEVTWVRDMLRGDDAFELQVKLVKQVPEEYPYKDDD

SEQ ID NO: 7237 - protein, 186 aa, Cirsium arvense
MAPAVPRSGDAIFANVERVNAELFTLTYGAIVRQLLTDLEEVEEVNKQLDQMGYNIGIRLIDEFLAKSNVTRCVDFRETAEVIAKVGFKMFLGVTASVTNWDSEGTSCSLILEDNPLVDFVELPDTCQGLYYCNILSGVVRGALEMVSMKTEVTWVRDMLRGDDAFELQVKLLKQVPEEYPYKDDE

SEQ ID NO: 7238 - protein, 186 aa, Elaeis guineensis
MAPLAPRTGDAIFANVERVNAELFTLTYGAIVRQLLTDLEEVEEVNKELDQMGYNIGVRLIDEFLAKSNVSRCVDFKETANVIAKVGFKMFLGVTASVTNWDAEGTTCSLVLEDNPLVDFVELPDTCQGLHYCNILSGVIRGALEMVSMKTEVAWVRDMLHGDDAYELQVKLVKQVPEEYPYKEDD

SEQ ID NO: 7239 - protein, 186 aa, Lippia dulcis
MAPAAPKSGDVIFASVDRVNAELFTLTYGAIVRQLITDLEEVEEVNKQLDQMGYNIGVRLVDEFLAKSSVSRCVDFRETADVIAKVGFKMFLGVTASITNWDAEGTTCSLILEDNPLVDFVELPDTCQGLHYCNILSGVVRGALEMVSMKTEVTWVRDMLRGDDVFELQVKLLKQVPEEYPYKDDE

SEQ ID NO: 7240 - protein, 186 aa, Platanus occidentalis
MAPLVPRSGDAVFANVERVNAELFTLTYGAMVRQLLTDLEEVEEVNKQLDQMGYNIGIRLIDEFLAKSGVSRCVDFKETAEVIAKVGFKMFLGVTASVTNWDADGTSCSLVLEDNPLVDFVELPDTCQGLHYCNILSGVIRGALEMVSMKTEVTWIRDMLRGDDAFELRVKLLKQVPEEYPYKDDE

SEQ ID NO: 7241 - protein, 186 aa, Persea americana
MAPLAPRSGDAVFANIERVNAELFTLTYGAIVRQLLTDLEEVEEVNKQLDQMGYNIGIRLIDEFLAKSNVSRCVDFKETAEVIAKVGFKMFLGVTASVTNWDADGTTCSLVLEDNPLVDFVELPDTCQGLYYCNILSGVVRGALEMVSMKTEVTWIRDMLRGDDTYELRVKLLKQVPEEYPYKDDE

SEQ ID NO: 7242 - protein, 186 aa, Cucumis melo
MPTAGPRSGDAIFASVERVNAELFTLTYGATVRQLLTDLEEVEEVNKQLDQMGYNIGIRLIDEFLAKSNISRCVDFKETADVIAKVGLKMFLGVNATVTNWDAEGTCCSIVLEDNPLVDFVELPDTCQGLHYCNILSGVIRGALEMVSMKTEVTWLRDMLRGDDSFELQVKLLKQVPEEYPYKDDE

SEQ ID NO: 7243 - protein, 186 aa, Quercus alba
MAPVAPRSGDAIFASVERVNAELFTLTYGAIVRQLLTDLEEVEEVNKQLDQMGYNIGIRLIDEFLAKSNVARCVDFKETAEVIAKVGFKMFLGVTASVSNWDADGTCCSIVLEDNPLVDFVELPDTCQGLYYCNVLSGVIRGALEMVSMKTEVTWVRDMLRGDDAFELQVKLLKQVPEEYPYKDDE

SEQ ID NO: 7244 - protein, 186 aa, Populus trichocarpa
MAPVAPRSGDAIFASVEHVNAELFTLTYGAIVRQLLTDLEEVEEVNKQLDQMGYNIGVRLIDEFLAKSNVSRCVDFKETADVIAKVGFKMFLGVGASVTNWDADGTCCSIVLEDNPLVDFVELPDTCQGLYYCNILSGVVRGALEMVSMKTEVTWVRDMLRGDDAFELQVKLLKQVPEEYPYKDDE

SEQ ID NO: 7245 - protein, 186 aa, Euphorbia esula
  misc_feature (167)..(167): Xaa can be any naturally occurring amino acid
MPAAGPRSGDAIFASVERVNAELFTLTYGAIVRQLLTDLEEVEEVNKQLDQMGYNIGIRLVDEFLAKSNVTRCVDFKETCEVIAKVGFKMFLGVSASVTNWDAEGTCCSIILEDNPLVEFVELPDTCQGLYYCNVLSGVIRGALEMVSMKTEVTWVRDMLRGDDAFXLQVKLVKQVPEEYPYKDDD

SEQ ID NO: 7246 - protein, 186 aa, Bupleurum chinense
MAPVAPKSGDAIFANVDRVNAELFTLTYGAIVRQLLTDLEEVDEVNKQLDQMGYNIGIRLIDEFLAKSNVSTCVDFKETAEVIAKVGFKMFLGVTASVTNWDPEGTTCSIILEDNPLVDFVELPDTCQGLSYCNILSGVVRGALEMVSMKTEITWARDMLRGDDAYELRLKLIKQVPEEYPYKDDE

SEQ ID NO: 7247 - protein, 186 aa, Cirsium arvense
MAPAVPRSGDAIFANVERVNSELFTLTYGAIVRQLLTDLEEVEEVNKQLDQMGYNIGIRLIDEFLAKSNVTRCVDFRETAEVIAKVGFKMFLGVTASVTNWDVEGTSCSLILEDNPLVDFVELPDTCQGLYYCNILSGVVRGALEMVSMKTEVTWVRDMLRGDDAFELQVKLLKQVPEEYPYKDDE

SEQ ID NO: 7248 - protein, 186 aa, Cucurbita pepo
MPTAGPRSGDAIFASVERVNAELFTLTYGATVRQLLTDLEEVEEVNKQLDQMGYNIGIRLIDEFLAKSNISRCVDFKETADVIAKIGLKMFLGVNATVTNWDAEGTCCSIVLEDNPLVDFVELPDTCQGLHYCNILSGVIRGALEMVSMKTEVTWLRDMLRGDDSFELQVKLLKQIPEEYPYKDDE

SEQ ID NO: 7249 - protein, 186 aa, Flaveria ramosissima
MAPAVPRSGDAIFANVERVNAELFTLTYGAIVRQLLTDLEEVEEVNKQLDQMGYNIGIRLIDEFLAKSNVTRCVEFRETAEVIAKVGFKMFLGVTASVTNWDTEGTSCSLILEDNPLVDFVELPDTCQGLYYCNILSGVIKGALEMVSMKTEVTWVRDMLRGDDAFELQVKLLKQVPEEYPYKDDE

SEQ ID NO: 7250 - protein, 186 aa, Flaveria ramosissima
MAPAVPRSGDAIFANVERVNAELFTLTYGAIVRQLLTDLEEVEEVNKQLDQMGYNIGIRLIDEFLAKSNVTRCVDFRETAEVIAKVGFKMFLGVTASVTNWDTEGTSCSLILDDNPLVDFVELPDTCQGLYYCNILSGVVRGALEMVSMKTEVTWVRDMLRGDDAFELQVKLLKQVPEEYPYKDDE

SEQ ID NO: 7251 - protein, 186 aa, Flaveria ramosissima
MAPAVPRSGDAIFANVERVNAELFTLTYGAIVRQLLTDLEEVEEVNKQLDQMGYNIGIRLIDEFLAKSNVTRCVDFRETAEVIAKVGFKMFLGVTASVSNWDSEGTSCSLILEDNPLVDFVELPDTCQGLYYCNILSGVVRGALEMVSMKTEVTWVRDMLRGDDAFELQVKLLKQVPEEYPYKDDE

SEQ ID NO: 7252 - protein, 186 aa, Phalaenopsis aphrodite
MAPVVPRSGDAVFANVERVNAELFTLTYGAIVRQLLTDLEEVEEVNKQLDQMGYNIGVRLIDEFLAKSNTSRCVDFRETAEVIAKVGFKMFLGVTATVTNWDVEGTSCSLVLEDNPLVEFVELPDSCQGLYYCNILSGIIRGALEMVSMKTEVTWVRDMLHGDDAYELRLKLIKQVPEEYPYKDDE

SEQ ID NO: 7253 - protein, 186 aa, Papaver somniferum
MAPVGPRSGDAIFANVERVNAELFSLTYGAMVRQLLTDLEEVEEVNKQLDQMGYNIGIRLIDEFLAKSNVSSCADFKESADVIAKVGFKMFLGVTATVANWDADGTSCSLILEDNPLVDFVELPDTCQGLYYCNVLSGVIRGALEMVSMKTEVTWVRDMLRGDDAYELRVKLLKQVPEEYPYKDDE

SEQ ID NO: 7254 - protein, 186 aa, Silene vulgaris
MPAIAPRSGEAIFASAERVNAELFTLTYGAIVRQLLTDLEEVDEVNKQLDLMGYNIGIRLIDEFLAKSNVSRCVDFKETAEVIAKIGFKMFLGVTATVTNWDQDGTTCSLVLEDNPLVDFVELPDTCQGLHYCNVLSGVIRGALEMVSMKTEVTWVKDMLHGDDAYELQVKLLKQVPEEYPYKDDE

SEQ ID NO: 7255 - protein, 186 aa, Centaurea maculosa
MAPAVPRSGDAIFANVERVNSELFTLTYGAIVRQLLTDLEEVEEVNKQLDQMGYNIGIRLIDEFLAKSNVTRCVDFRETAEVIAKVGFKMFLGVTASVTNWDSEGTSCSLILEDNPLVDFVELPDTCQGLYYCNILSGVVRGALEMVSMKTEVTWVRDMLRGDDAFELQVKLLKQVPEEYPYKDDE

SEQ ID NO: 7256 - protein, 186 aa, Castanea mollissima
MAPVAPRSGDAIFASVERVNAELFTLTYGAIVRQLLTDLEEVEEVNKQLDQMGYNIGIRLIDEFLAKSNVARCVDFKETAEVIAKVGFKMFLGVTASVSNWDADGTCCSIVLEDNPLVDFVELPDTCQGLYYCNVLSGVIRGALEMVSMKTEVSWVRDMLRGDDAFELQVKLLKQVPEEYPYKDDE

SEQ ID NO: 7257 - protein, 186 aa, Unknown
  Sequence found in Organisms: Rosa hybrid cultivar, Fragaria vesca
MPPVGPRSGDAIFANVERVNAELFTLTYGAIVRQLLTDLEEVEEVNKQLDQMGYNIGIRLIDEFLAKSNVSRCVDFKETAEVIAKIGFKMFLGVTASVTNWDADGTCCSIVLEDNPLVDFVELPDTCQGLYYCNILSGVVRGALEMVSMKTEITWIRDMLRGDDAFELQVKLLKQVPEEYPYKDDE

SEQ ID NO: 7258 - protein, 186 aa, Triphysaria pusilla
MAPTAPKSGDAIFASVDRVNAELFTLTYGAIVRQLLTDLEEVDEVNKQLDQMGYNMGVRLVDEFLAKSNVSRCVDFRETAEVIAKVGFKMFLGVTASVTNWDSEGTTCSLILEDNPLVDFVELPDTCQGLHYCNILSGVVRGALEMVSMKAEVTWLRDMLRGDDVFELQVKLLKQIPEEYPYKDDE

SEQ ID NO: 7259 - protein, 93 aa, Momordica charantia
MPPAGPRSGDAIFASVERVNAELFTLTYGATVRQLLTDLEEVEEVNKQLDQMGYNIGIRLIDEFLAKSNISRCVDFKETAEVIAKVGLKMFWV

SEQ ID NO: 7260 - protein, 180 aa, Eschscholzia californica
RSGDAIFANVERVNAELFTLTYGAMVRQLLTDLEEVDEVNKQLDLMGYNIGIRLIDEFLAKSNVSRCVDFKDSADVIAKVGFKMFLGVTATVTNWDADGTSCSLVLEENPLVDFVELPDTCQGLYYCNVLSGVIRGALEMVSMKTEVTWVRDMLRGDDAYELRVKLLKQVPEEYPYKDDE

SEQ ID NO: 7261 - protein, 187 aa, Triphysaria pusilla
MAPAAAPKSGDAIFASIDRVNAELFTLTYGAIVRQLLTDLEEVEEVNKQLDQMGYNMGVRLVDEFLAKSNVSRCVDFRETAEVIAKVGFKMFLGVTASVTNWDSEGTTCSLILEDNPLVDFVELPDTCQGLHYCNILSGVVRGALEMVSMKTEVTWLRDMLRGDDVFELQVKLLKQIPEEYPYKDDE

SEQ ID NO: 7262 - protein, 186 aa, Malus domestica
MPPAGPRSGDAIFANVERVNAELFTLTYGAIVRQLLTDLEEVEEVNKQLDQMGYNIGIRLIDEFLAKSNVSRCVDFKETAEVIAKVGFKMFLGVTASVTNWDADGTCCSIVLEDNPLVDFVELPDTCQGLYYCNILSGVVRGALEMVSMKTEISWIRDMLRGDDAFELQVKLLKQIPEEYPYKDDE

SEQ ID NO: 7263 - protein, 186 aa, Arnica chamissonis
MAPAVPRSGDAIFANVERVNAELFTLTYGAIVRQLLTDLEEVEEVNKQLDQMGYNIGIRLIDEFLAKSNVTRCVDFRETAEVIAKVGFKMFLGVTASVTNWDTAGTCCSLILEDNPLVDFVELPDTCQGLYYCNILSGVVRGALEMVSMKTEVTWVRDMLRGDDAFELQVKLLKQVPEEYPYKDDE

SEQ ID NO: 7264 - protein, 186 aa, Euonymus alatus
MPPVAPRSGDAIFASVERVNAELFTLTYGAIVRQLLTDLEEVEEVNKQLDQMGYNIGIRMIDEFLAKSGVSRCVDFKETAEVIAKVGFKMFLGVTASVTNWNADGTCCSIVFEDNPLVEFVELPDTCQGLNYCNILSGVVRGALEMVSMKTEVTWTRDMLRGDDAFELQVKLIKQVPEEYPYKDDE

SEQ ID NO: 7265 - protein, 185 aa, Euphorbia peplus
MPPPGPRSGDAIFASVERVNAELFTLTYGAIVRQLLTDLEEVEEVNKQLDQMGYNIGIRLVDEFLAKSNVTRCVDFKETAEVIAKVGFKMFLGVSASVTNWDAEGTCCSIILEDNPLVEFVELPDTCQGLYYCNILSGVIRGALEMVSMKTEVTWVRDMLRGDDAFELQVKLVKQVPEEYPYKMT

SEQ ID NO: 7266 - protein, 186 aa, Flaveria ramosissima
MAPAVPRSGDAIFANVERVNAELFTLTYGAIVRQLLTDLEEVEEVNKQLDQMGYNIGIRLIDEFLAKSNVTRCVDFRETAEVIAKVGFKMFLGVTASVTNWDTEGTCCSLILDDNPLVDFVELPDTCQGLHYCNILSGVVRGALEMVSMKTEVTWVRDMLRGDDAFELQVKLLKQVPEEYPYKDDE

SEQ ID NO: 7267 - protein, 186 aa, Lippia dulcis
MAPIAPKSGDAIFASVDRVNAELFTLTYGAIVRQLLTDLEEVEEVNKQLDQMGYNIGVRLVDEFLAKSSVSRCVDFRETAEVIAKVGFKMFLGVTASVSNWDSEGTTCSLILEDNPLVDFVELPDTYQGLYYCNILSGVVRGALEMVSMKTEVTWLRDMLRGDDVFELQVKLLKQVPEEYPYKDDE

SEQ ID NO: 7268 - protein, 186 aa, Sarracenia psittacina
MAPVAPRSGDAIFASVERVNAELFTLTYGAIVRQLLTDLEEVEEVNKQLDQMGYNIGVRLVDEFLAKSNVSRCVDFKETSEVIAKVGFKMFLGVTASVTNWDADGTCFSLILEDNPLVDFVELPDTCQGLYYCNILSGVVRGALEMVSMKTEVTWIRDMLRGDDVFELQVKLLKQVPEEYPYKDDE

SEQ ID NO: 7269 - protein, 186 aa, Helianthus annuus
MAPAVPRSGDAIFANVERVNAELFTLTYGAIVRQLLTDLEEVEEVNKQLDQMGYNIGIRLIDEFLAKSNVTRCVDFRETAEVIAKVGFKMFLGVTASVSNWDTEGTCCSLILEDNPLVDFVELPDTCQGLYYCNILSGVVRGALEMVSMKTEVTWVRDMLRGDDAFELQVKLLKQVPEEYPYKDDE

SEQ ID NO: 7270 - protein, 186 aa, Acacia harpophylla
MAPVGPRSGEAIFASVERVNAELFTLTYGAIVRQLLTDLEEVEEVNKQLDQMGYNIGIRLIDEFLAKSNVSRCVDFKETAEVIAKVGFKMFLGVTASVTNWDAEGTCCNIVLEDNPLVDFVELPDTCQGLYYCNILSGVIRGAMEMVSMKTEVTWVRDMLRGDDVFELQVKLLKQVPEEYPYKDDE

SEQ ID NO: 7271 - protein, 186 aa, Ricinus communis
MAPVGPRSGDAIFASVERVNAELFTLTYGAIVRQLLTDLEEVEEVNKQLDQMGYNIGIRLVDEFLAKSNVNRCVDFRETAEVIAKVGFKMFLGVSASVTNWDADGTCCSIILEDNPLVDFVELPDTCQGLYYCNILSGVIRGALEMVSMKTEVTWARDMLRGDDAYELQVKLLKQVPEEYPYKDDE

SEQ ID NO: 7272 - protein, 186 aa, Centaurea maculosa
  misc_feature (63)..(63): Xaa can be any naturally occurring amino acid
MAPAVPRSGDAIFANVERVNSELFTLTYGAIVRQLLTDLEEVEEVNKQLDQMGYNIGIRLIDXFLAKSNVTRCVDFRETAEVIAKVGFKMFLGVTASVTNWDVEGTSCSLILEDNPLVDFVELPDTCQGLYYCNILSGVVRGALEMVSMKTEVTWVRDMLRGDDAFELQVKLLKQVPEEYPYKDDE

SEQ ID NO: 7273 - protein, 186 aa, Mimulus guttatus
MAPVAPKSGDAIFASVDRVNAELFTLTYGAIVRQLLTDLEEVDEVNKQLDQMGYNIGIRLVDEFLAKSNVSRCVDFRETAEVIAKVGFKMFLGVTASVTNWDSEGTTCSIILEDNPLVDFVELPDNCQGLYYCNILSGIIRGALEMVSMKTEVTWLRDMLRGDDVFEMQVKLLKAVPEEYPYKDDE

SEQ ID NO: 7274 - protein, 186 aa, Petunia hybrida
MAPVAPRSGDAIFANVERVNAELFTLTYGAIVRQLLTDLEEVDEVNKQLDQMGYNIGIRLIDEFLAKSNVSRCVDFKESADVIAKVGLKMFLGVTATVTNWDVEGTTCSLILEDNPLVDFVELPDTCQGLYYCNILSGVIRGALEMVSMKTEVTWLRDMLRGDDAFELQLKLLKQVPEEYPYKDDE

SEQ ID NO: 7275 - protein, 186 aa, Prunus persica
MPPVGPRSGDAIFANVERVNAELFTLTYGAIVRQLLTDLEEVEEVNKQLDQMGYNIGIRLIDEFLAKSNVSRCVDFKETAEVIAKIGFKMFLGVTASVTNWDADGTCCSIVLEDNPLVDFVELPDTCQGLYYCNILSGVVRGALEMVSMKTEISWIRDMLRGDDAFELQVKLLKQVPEEYPYKDDE

SEQ ID NO: 7276 - protein, 186 aa, Rosa hybrid cultivar
MPPVGPRSGDAIFANVERVNAELFTLTYGAIVRQLLTDLEEVEEVNKQLDQMGYNIGIRLIDEFLAKSNVSRCVDFKETAEVIAKIGFKMFLGVTASVTNWDADGTCCSIVLEDNPLVDFVELPDTCQGLYYRNILSGVVRGALEMVSMKTEITWIRDMLRGDDAFELQVKLLKQVPEEYPYKDDE

SEQ ID NO: 7277 - protein, 186 aa, Salvia sclarea
MAPAAPKSGDVIFASVDRVNAELFTLTYGAIVRQLITDLEEVEEVNKQLDQMGYNIGVRLVDEFLAKSSVSRCVDFRETAEVIAKVGIKMFLGVTASVTNWDAEGTACSLILEDNPLVDFVELPDTCQGLHYCNILSGVVRGALEMVSMKTEVTWLRDMLRGDDVFELQVKLLKQVPEEYPYKDDE

SEQ ID NO: 7278 - protein, 135 aa, Heritiera littoralis
MGYNMGIRLIDEFLAKSYVSRCVDFKETAEVIAKVGFKMFLGVTASVTNWDVDGTCCSIVLEDNPLVDFVELPDTCQGLYYCNILSGVIRGALEMVSMKTEVTWIRDMLRGDDAYELQVKLLKQVPEEYPYKDDE

SEQ ID NO: 7279 - protein, 186 aa, Fagus grandifolia
MAPVAPRTGDAIFANVERVNAELFTLTYGAIVRQLLTDLEEVEEVNKQLDQMGYNIGIRLIDEFLAKSNVSRCVDFKETAEVIAKVGFKMFLGVTASVSNWDADGTCCSILLEDNPLVDFVELPDTCQGLYYCNILSGVIRGALEMVSMKTEVTWLRDMLRGDDAFELQVKLLKQVPEEYPYKDDE

SEQ ID NO: 7280 - protein, 186 aa, Cucurbita pepo
MPPAGPRSGDAIFASVERVNAELFTLTYGATVRQLLTDLEDVEEVNKQLDQMGYNIGIRLIDEFLAKSNISRCVDFKETADVIAKVGLKMFLGVNASVTNWDAEGTCCSIVLEDNPLVDFVELPDACQGLHYCNILSGVIRGALEMVSMKTEVTWLRDMLRGDDMFELQVKLLKQIPEEYPYKDDE

SEQ ID NO: 7281 - protein, 186 aa, Euonymus alatus
MPPVAPRSGDAIFASVERVNAELFTLTYGAIVRQLLTDLEEVEEVNKQLDQMGYNIGIRMIDEFLAKSGVSRCVDFKETAEVIAKVGFKMFLGVTASVTNWNADGTCCSIVFEDNPLVEFVELPDTCQGLNYCNILSGVVRGALEMVSMKTEVTWTRDMLRGDDAFELQVKLVKQVPEEYPYKDDE

SEQ ID NO: 7282 - protein, 186 aa, Sarracenia psittacina
MAPVAPRSGDAIFASVERVNAELFTLTYGAIVRQLLTDLEEVEEVNKQLDQMGYNIGVRLVDEFLAKSNVSRCVDFKETSEVIAKVGFKMFLGVTASVTNWDADGTCFSLILEDNPLVDFVELPDTCQGLYYCNILSGVVRGALEMVSMKTEVTWIRDMLRGDDVFELQVKPLKQVPEEYPYKDDE

SEQ ID NO: 7283 - protein, 186 aa, Helianthus annuus
MAPAVPRSGDAIFANVERVNAELFTLTYGAIVRQLLTDLEEVEEVNKQLDQMGYNIGIRLIDEFLAKSNVTRCVDFRETAEAIAKVGFKMFLGVTASVSNWDTEGTCCSLILEDNPLVDFVELPDTCQGLYYCNILSGVVRGALEMVSMKTEVTWVRDMLRGDDAFELQVKLLKQVPEEYPYKDDE

SEQ ID NO: 7284 - protein, 186 aa, Malus domestica
MPPVGPRSGDAIFANVERVNAELFTLTYGAIVRQLLTDLEEVEEVNKQLDQMGYNIGIRLIDEFLAKSNVSRCVDFKETAEVIAKVGFKMFLGVTASVTNWDADGTCCSIVLEDNPLVDFVELPDTCQGLYYCNILSGVVRGALEMVSMKTEISWIRDMLRGDDAFELQVKLLKQIPEEYPYKDDE

SEQ ID NO: 7285 - protein, 186 aa, Taraxacum officinale
MAPAVPRSGDAIFANVERVNAELFTLTYGAIVRQLLTDLEEVEEVNKQLDQMGYNIGIRLIDEFLAKSNVTRCVDFRETAEVIAKVGFKMFLGVTASVTNWDNEGTCCSLILEDNPLVDFVELPDTCQGLYYCNILSGVVRGALEMVSMKTEITWIRDMLRGDDAFELQVKLLKQVPEEYPYKDDE

SEQ ID NO: 7286 - protein, 186 aa, Lotus japonicus
MAPVAPRSGDAIFANIERVNAELFTLTYGAIVRQLLTDLEEVEEVNKQLDQMGYNIGIRLVDEFLAKSNVSRCVDFRETTDVIAKVGFKMFLGVTASVTNWDAEGTCCSIVLEDNPLVDFVELPDTCQGLYYCNILSGVIRGALDMVSMKTEVTWLRDVLRGDDVFELQVKLLKQVPEEYPYKDDE

SEQ ID NO: 7287 - protein, 186 aa, Nicotiana benthamiana
MAPVAPRSGDAIFANVERVNAELFTLTYGAIVRQLLTDLEEVEEVNKQLDQMGYNIGIRLIDEFLAKSNVSRCIDFKETAEVIAKVGLKMFLGVTATVGNWDAEGTTCSLILEDNPLVDFVELPDTCQGLYYCNILSGVIRGALETVSMKTEVTWIRDMLRGDDAFELQLKLLKQVPEEYPYKDDE

SEQ ID NO: 7288 - protein, 186 aa, Solanum tuberosum
MAPVAPRSGDAIFANVERVNAELFTLTYGAIVRQLLTDLEEVEEVNKQLDQMGYNIGIRLIDEFLAKSNVSRCIDFKETAEVIAKVGLKMFLGVTATVGNWNAEGTTCSLILEDNPLVDFVELPDTCQGLYYCNILSGVIRGALEMVSMKTEVTWIRDMLRGDDAFELQLKLVKQVPEEYPYKDDE

SEQ ID NO: 7289 - protein, 186 aa, Carthamus tinctorius
  misc_feature (3)..(3): Xaa can be any naturally occurring amino acid
  misc_feature (178)..(178): Xaa can be any naturally occurring amino acid
MAXAVPRSGDAIFANVERVNSELFTLTYGAIVRQLLTDLEEVEEVNKQLDQMGYNIGIRLIDEFLAKSNVTRCVDFRETAEVIAKVGFKMFLGVTASVTNWDVEGTSCSLILEDNPLVDFVELPDTCQGLYYCNILSGVVRGALEMVSMKTEVTWVRDMLRGDDAFELQVKLLKQVPXEYPYKDDE

SEQ ID NO: 7290 - protein, 186 aa, Unknown
  Sequence found in Organisms: Solanum lycopersicum, Solanum phureja
MAPVAPRSGDAIFANVERVNAELFTLTYGAIVRQLLTDLEEVEEVNKQLDQMGYNIGIRLIDEFLAKSNVSRCIDFKETAEVIAKVGLKMFLGVTATVGNWNAEGTTCSLILEDNPLVDFVELPDTCQGLYYCNILSGVIRGALEMVSMKTEVTWIRDMLRGDDAFELQLKLLKQVPEEYPYKDDE

SEQ ID NO: 7291 - protein, 186 aa, Nicotiana tabacum
MAPVAPRSGDAIFANVERVNAELFTLTYGAIVRQLLTDLEEVEEVNKQLDQMGYNIGIRLIDEFLAKSNVSRCIDFKETAEVIAKVGLKMFLGVTATVGNWDAEGTTCSLILEDNPLVDFVELPDTCQGLYYGNILSGVIRGALEMVSMKTEVTWIRDMLRGDDAFELQLKLLKQVPEEYPYKDDE

SEQ ID NO: 7292 - protein, 163 aa, Flaveria ramosissima
MAPTVPRSGDAIFANVERVNAELFTLTYGAIVRQLLTDLEEVEEVNKQLDQMGYNIGIRLIDEFLAKSNVTRCVEFRETAEVIAKVGFKMFLGVTASVTNWDTEGTSCSLILEDNPLVDFVELPDTCQGLYYCNILSGVVRGALEMVSMKTEVTWGQRYAKKR

SEQ ID NO: 7293 - protein, 188 aa, Primula obconica
MAPPMVAPRSGDAIFASVDRVNAELFTLTYGAIVRQLLTDLEEVDEVNKQLDLMGYNIGIRLIDEFLAKSNVSRCVDFKETAEVIAKVGLKMFLGVTASVSNWDADGTCCSLILEDNPLVDFVELPDTCQGLYYCNILSGVIRGALEMVSMKTEVTWIRDMLRGDDAFELQVKLLKQIPEEYPYKDDE

SEQ ID NO: 7294 - protein, 186 aa, Ambrosia trifida
MAPAVPRSGDAIFANVERVNAELFTLTYGAIVRQLLTDLEEVDEVNKQLDQMGYNIGIRLIDEFLAKSNVTRCVDFRETAEVIAKVGFKMFLGVTASVSNWDTEGTCCSLILEDNPLVDFVELPDTCQGLYYCNILSGVVRGALEMVSMKTEVTWIRDMLRGDDAFELQVKLLKQVPEEYPYKDDE

SEQ ID NO: 7295 - protein, 186 aa, Ambrosia trifida
MAPALPRSGDTIFANVERVNAELFTLTYGAIVRQLLTDLEEVEEVNKQLDQMGYNIGIRLIDEFLAKSNVTRCVDFRETAEVIAKVGFKMFLGVTASVSNWDTEGTCCSLILEDNPLVDFVELPDTCQGLYYCNILSGVVRGALEMVSMKTEVTWIRDMLRGDDASELQVKLLKQVPEEYPYKDDE

SEQ ID NO: 7296 - protein, 186 aa, Phaseolus coccineus
MPPVAPRSGDAIFANVERVNAELFTLTYGAIVRQLLTDLEEVEEVNKQLDQMGYNIGIRLIDEFLAKSNVSRCNDFKETTDVIAKVGFKMFLGVTASVTNWDADGTCCSIVLEDNPLVDFVELPDNCQGLYYCNILSGVIRGALDMVSMKTEVTWLRDVLRGDDLFELQVKLLKHVPEEYPYKDDE

SEQ ID NO: 7297 - protein, 186 aa, Cicer arietinum
MAPVAPRSGDAIFANIERVNAELFTLTYGAIVRQLLTDLEEVEEVNKQLDQMGYNIGIRLIDEFLAKSNVSRCVDFRETAEVIAKVGFKMFLGVTASVTNWDAEGTCCSIVLEDNPLVDFVELPDNCQGLYYCNILSGVIRGALDMVSMKAEVTWLRDALRGDDVFELQVKLLKQVPEEYPYKDDE

SEQ ID NO: 7298 - protein, 186 aa, Eucalyptus grandis
MPTVGPRSGDAIFANVERVNAELFTLTYGAIVRQLLTDLEEVEEVNKQLDQMGYNIGTRLIDEFLAKANISRCVDFKETAEMIAKVGFKMFLGVTASVTNWDIEGTCCSVVLEENPLVDFVELPDTCQGLYYCNVLCGVIRGALEMVSMKTEVTWVRDVLRGDDSYELQVKLLKQVPEEYPYKDDE

SEQ ID NO: 7299 - protein, 186 aa, Linum usitatissimum
MAPAGPRSGDAVFASVERVNAELFTLTYGAIVRQLLTDLEEVDEVNKQLDQMGYNIGIRLIDEFLAKSNVSRCVDFKETTETIAKVGFKMFLGVGASVTNWDAEGTCCSIVFDDNPLVDFVELPDTCQGLYYCNVLSGVIRGALEMVSMKTEVSWVRDVLRGDDVFELQVKLIKQVPEEYPYKDDE

SEQ ID NO: 7300 - protein, 186 aa, Unknown
  Sequence found in Organisms: Pisum sativum, Trigonella foenum-graecum
MAPVAPRSGDAIFANIERVNAELFTLTYGAIVRQLLTDLEEVEEVNKQLDQMGYNIGIRLIDEFLAKSNVSRCVDFRETADVIAKVGFKMFLGVTASVTNWDAEGTCCSIVLEDNPLVDFVELPDNYQGLYYCNILSGVIRGALDMVSMKAEVTWLRDALRGDDVFELQVKLLKQVPEEYPYKDDE

SEQ ID NO: 7301 - protein, 186 aa, Artemisia annua
MAPAVPRSGDAIFANVERVNAELFTLTYGAIVRQLLTDLEEVEEVNKQLDQMGYNIGIRLIDEFLAKSNVTRCVDFRETAEVIAKVGFKMFLGVTASVTNWDSEGTCCSLILEDNPLVDFVELPDTCQGLYYCNILSGVVRGALEMVSMKTEITWIRDMLRGDDAFELQVKLLKQIPEEYPYKDDE

SEQ ID NO: 7302 - protein, 186 aa, Cichorium intybus
MAPAVPRSGDAIFANVERVNAELFTLTYGAIVRQLLTDLEEVEEVNKQLDQMGYNIGIRLIDEFLAKSNVTRCVNFRETAEVIAKVGFKMFLGVTASVTNWDQEGTCCSLILEDNPLVDFVELPDTCQGLYYCNILSGVVRGALEMVSMKTEITWIRDMLRGDDAFELQVKLLKQVPEEYPYKDDE

SEQ ID NO: 7303 - protein, 186 aa, Solanum melongena
MTPVVPRSGDAIFANVERVNAELFTLTYGAIVRQLLTDLEEVDEVNKQLDQMGYNIGIRLIDEFLAKSNVSRCVDFKETAEVIAKVGLKMFLGITATVTNWDVEGTTCSLILEDNPLVDFVELPDTCQGLYYCNILSGVIRGALEMVSMKTEVTWLRDMLRGDDAFELQLKLLKQVPEEYPYKDDE

SEQ ID NO: 7304 - protein, 186 aa, Lactuca sativa
MAPAVPRSGDAIFANVERVNAELFTLTYGAIVRQLLTDLEEVEEVNKQLDQMGYNIGIRLIDEFLAKSNVTRCVDFRETAEVIAKVGFKMFLGVTASVTNWDNEGTCCSLILEDNPLVDFVELPDNCQGLYYCNILSGVVRGALEMVSMKTEITWIRDMLRGDDAFELQVKLLKQVPEEYPYKDDE

SEQ ID NO: 7305 - protein, 186 aa, Mimulus guttatus
MAPAAPKSGDAIFASVDRVNAELFTLTYGAIVRQLLTDLEEVEEVNKQLDQMGYNMGVRLVDEFLAKSNVTRCVDFRETTEVIAKVGFKMFLGVTASVTNWDSEGTTCSLILEDNPLVDFVELPDNCQGLHYCNILSGVVRGALEMVSMKTEVAWLRDMLRGDDVFELQVKLLKQVPEEYPYKDDE

SEQ ID NO: 7306 - protein, 186 aa, Unknown
  Sequence found in Organisms: Solanum tuberosum, Solanum phureja
MAPVAPRSGDAIFANVERVNAELFTLTYGAIVRQLLTDLEEVDEVNKQLDQMGYNIGIRLIDEFLAKSNVSRCVDFKETAEVIAKVGLKMFLGITATVTNWDVEGTTCSLILEDNPLVDFVELPDTCQGLYYCNILSGVVRGALEMVSMKTEVTWLRDMLRGDDAFELQLKLLKQVPEEYPYKDDE

SEQ ID NO: 7307 - protein, 186 aa, Tragopogon dubius
MAPAVPRSGDAIFANVERVNAELFTLTYGAIVRQLLTDLEEVEEVNKQLDQMGYNIGIRLIDEFLAKSNVTRCVDFRETAEVIAKVGFKMFLGVTASVTNWDMDGTCCSLILEDNPLVDFVELPDTCQGLYYCNILSGVVRGALEMVSMKTEITWIRDMLRGDDAFELQVKLLKQVPEEYPYKDDE

SEQ ID NO: 7308 - protein, 135 aa, Ambrosia trifida
MGYNIGIRLIDEFLAKSNVTRCVDFRETAEVIAKVGFKMFLGVTASVSNWDTEGTCCSLILEDNPLVDFVELPDTCQGLYYCNILSGVVRGALEMVSMKTEVTWIRDMLRGDDAFELQVKLLKQVPEEYPYKDDE

SEQ ID NO: 7309 - protein, 169 aa, Flaveria ramosissima
MAPSVPRSGDAIFANVERVNAELFALTYGAIVRQLLTDLEEVEEVNKQLDQMGYNIGIRLIDEFLAKSNVTRCVEFRETAEVIAKVGFKMFLGVTASVTNWDTEGTSCSLILEDNPLVDFVELPDTCQGLYYCNILNGVVRGALEMVSMKTEVTWVRDMLRGDDAFELQ

SEQ ID NO: 7310 - protein, 76 aa, Papaver somniferum
PRSGDAIFANVERVNAELFSLTYGAMVRQLLTDLEEVEEVNKQLDQMGYNIGIRLIDEFLAKSNVSSCADFKDLLM

SEQ ID NO: 7311 - protein, 187 aa, Eucalyptus grandis
MSRASGPRSGDAIFASVERVNAELFTLTYGAIVRQLLTDLEEVEEVNKQLDQMGYNIGIRLIDEFLAKSNVGRCVDFKETAEMIAKVGFKMFLGVTASVTNWDADGTCCSIVLEDNPLVDFVELPDTCQGLYYCNILSGVIRGALEMVSMKTEVTWIRDVLRGDDAFELQVKLLKQVPEEYPYKDDE

SEQ ID NO: 7312 - protein, 183 aa, Euonymus alatus
MPHVAPRSGDAIFASVERVNAELFTLTYGAIVRQLLTDLEEVEEVNKQLDQMGYNIGIRMIDEFLAKSGVSRCVDFKETAEVIAKVGFKMFLGVTASVTNWNADGTCCSIVFEDNPLVEFVELPDTCQGLNYCNILSGVVRGALEMVSMKTEVTWTRDMLRGDDAFELQVKLINKFRRISIQG

SEQ ID NO: 7313 - protein, 186 aa, Linum usitatissimum
MAPAGPRSGDAIFASVERVNAELFTLTYGAIVRQLLTDLEEVDEVNKQLDQMGYNIGIRLIDEFLAKSNVSRCVDFKETTETIAKVGFKMFLGVGASVTNWDAEGTCCSIVFDDNPLVDFVELPDTCQGLYYCNVLSGVIRGALEMVSMKTEVSWLRDVLRGDDVFELQVKLIKQVPEEYPYKDDE

SEQ ID NO: 7314 - protein, 186 aa, Carpinus betulus
MAPVGPRTGDAIFSNVERVNAELFTLTYGAIVRQLLTDLEEVEEVNKQLDQMGYNIGIRLIDEFLAKSNVSRCIDFKETAETIAKVGFKMFLGVTASVTNWDADGTCCSIVLEDNPLVDFVELPDTCQGLYYCNILSGVIRGALEMVSMKTEVTWVRDTLRGDDAFELQVKLLKQVPEEYPYKDDE

SEQ ID NO: 7315 - protein, 186 aa, Beta vulgaris
MPAVPPRSGEAIFASAERVNAELFTLTYGAIVRQLITDLEEVDEVNKQLDQMGYNIGVRLIDEFLAKSNVTRCVDFKETAEVIAKVGFKMFLGVSATVTNWDAEGTTCSFVLEDNPLVDFVELPDTCQGLHYCNVLNGVIRGALEMVSMKTEVTWIRDMLRGDDTYELQVKLLKQIPEEYPYKDDE

SEQ ID NO: 7316 - protein, 186 aa, Cicer arietinum
MAPVAPRSGDAIFANIERVNAELFTLTYGAIVRQLLTDLEEVEEVNKQLDQMGYNIGIRLIDEYLAKSNVSRCVDFRETAEVIAKVGFKMFLGVTASVTNWDAEGTCCSIVLEDNPLVDFVELPDNCQGLYYCNILSGVIRGALDMVSMKAEVTWLRDALRGDDVFELQVKLLKQVPEEYPYKDDE

SEQ ID NO: 7317 - protein, 186 aa, Cichorium intybus
MAPAVPRSGDAIFANVERVNSELFTLTYGAIVRQLLTDLEEVEEVNKQLDQMGYNIGIRLIDEFLAKSNVTRCVNFRETAEVIAKVGFKMFLGVTATVTNWDSEGTSCSLILEDNPLVDFVELPETCQGLYYCNILSGVVRRALEMVSMKTEITWVRDMLRGDDAFELQVKLLKQVPEEYPYEDDE

SEQ ID NO: 7318 - protein, 186 aa, Unknown
  Sequence found in Organisms: Citrus sinensis, Citrus clementina, Citrus sinensis
MAPVGPRSGDAIFANVERVNAELFTLTYGATVRQLLTDLEEVEEVNKQLDQMGYNIGIRLIDEFLAKSNVTRCVDFRETAEVIAKVGFKMFLGVTATVSNWDADGTCCSIILEDNPLVDFVELPDTCQGLYYCNILSGVIRGALEMVSMKTEVTWIRDVLRGDDAYELQVKLLKQVPEEYPYKDDE

SEQ ID NO: 7319 - protein, 186 aa, Solanum melongena
MAPVAPRSGDAIFANVERVNAELFTLTYGAIVRQLLTDLEEVEEVNKQLDQMGYNIGIRLIDEFLAKSNVSRCIDFKETAEVIAKVGLKMFLGVTANVGNWNVEGTMCSLILEDNPLVDFVELPDTCQGLYYCNILSGVIRGALEMVSMKTEVTWIRDMLRGDDAFELQLKLLKQVPEEYPYKDDE

SEQ ID NO: 7320 - protein, 186 aa, Eucalyptus grandis
MPTVGPRSGDAIFANVERVNAELFTLTYGAIVRQLLTDLEEVEEVNKQLDQMGYNIGTRLIDEFLAKANISRCVDFKETAEMIAKVGFKMFLGVTASVTNWDIEGTCCNMVLEENPLVDFVELPDTCQGLYYCNVLCGVIRGALEMVSMKTEVTWVRDVLRGDDSYELQVKLLKQVPEEYPYKDDE

SEQ ID NO: 7321 - protein, 186 aa, Tropaeolum majus
MPSVGPRSGDAIFANVEHVNAELFTLTYGAIVRQLLTDLEEVEEVNKQLDQMGYNIGIRLIDEFLAKSNVSRCVDFKETAEMIAKVGFKMFLGVTASVTHWDTDGTCCSIVLEDNPLVDFVELPDTCQGLYYCNILSGVIKGALEMVSMKTEVTWLRDLLRGDDAYELQVKLVKQVPEEYPYKDDE

SEQ ID NO: 7322 - protein, 186 aa, Arachis hypogaea
MAPVAPRSGDAIFANIERVNAELFTLTYGAIVRQLLTDLEEVEEVNKQLEQMGYNIGIRLIDEFLAKSNVSRCVDFRETADVIAKVGFKMFLGVTASVSNWDAEGTCCSIILEDNPLVDFVELPDTCQGLYYCNMLSGVIRGALEMVSMKTEVTWIRDVLRGDDVFELQVKLLKQVPEEYPYKDDE

SEQ ID NO: 7323 - protein, 186 aa, Capsicum annuum
MAPVAPRSGDVIFANVERVNAELFTLTYGAIVRQLLTDLEEVDEVNKQLDQMGYNIGVRLIDEFLAKSNVSRCVDFKETAEVIAKVGLKMFLGITATVTNWDVEGTTCSLILEDNPLVDFVELPDTCQGLNYCNILSGVVRGALEMVSMKTEVTWLRDMLRGDDAFELQLKLLKQVPEEYPYKDDE

SEQ ID NO: 7324 - protein, 184 aa, Helianthus annuus
MAPAVPRSGDAIFANVERVNAELFTLTYGAIVRQLLMEEVEEVNKQLDQMGYNIGIRLIDEFLAKSNVTRCVDFRETAEVIAKVGFKMFLGVTASVSNWDTEGTCCSLILEDNPLVDFVELPDTCQGLYYCNILSGVVRGALEMVSMKTEVTWVRDMLRGDDAFELQVKLLKQVPEEYPYKDDE

SEQ ID NO: 7325 - protein, 186 aa, Nicotiana tabacum
MAPVAPRSGDAIFANVERVNAELFTLTYGAIVRQLLTDLEEVGEVNKQLDQMGYNIGIRLIDEFLAKSNVSRCVDFKETAEIIAKVGLKMFLGVTASVTNWDVEGTTCSLILEDNPLVDFVELPDTCQGLYYCNILSGVVRGALEMVSMKTEVTWLRDMLRGDDAFELQLKLLKQVPEEYPYKDDE

SEQ ID NO: 7326 - protein, 120 aa, Bupleurum chinense
MAPVAPKSGDAIFANVDRVNAELFTLTYGAIVRQLLTDLEEVDEVNKQLDQLGYNIGIRLIDEFLAKSNVSTCVDFKETAEVIAKVGFKMFLGVTASVSNWDPEGTTCSIILRISIGRLC

SEQ ID NO: 7327 - protein, 173 aa, Guizotia abyssinica
MAPAVPRSGDAIFANVERVNAELFTLTYGAIVRQLLTDLEEVEEVNKQLDQMGYNIGIRLIDEFLAKSNVTRCVDFRETAEVIAKVGFKMFLGVTASVTNWDTEGTCCSLILDDNPLVDFVELPDTCQGLYYCNILSGVVRGALEMVSMKTEVTWVRDMLRGDDAFELQVKLL

SEQ ID NO: 7328 - protein, 71 aa, Allium cepa
MAPLAPRSGDAIFANVERINAELFTLTYGAMVRQLLTDLEEVDEVNKQLDQMGYNIGIRLIDEFLAKSNGV

SEQ ID NO: 7329 - protein, 172 aa, Cenchrus ciliaris
SVDRVNAELFTLTYGAIVRQLLTDLEEVEEVNKQLDQMGYNIGTRLVDEFLAKSNVSRCVDFKETADVIAKLGFKMFLGVTATVTSWDAEGTSCSFVLDPLFFFDFVELPGGGQKKKYCNVLSGVIRGALEMVSMKTEVTWVRDMLRGDDAYEMRVKLIKQVPEEYPYKDDD

SEQ ID NO: 7330 - protein, 186 aa, Ambrosia trifida
MAPALPRSGDTIFANVERVNAELFTLTYGAIVRQLLTDLEEVEEVNKQLDQMGYNIGIRLIDEFLAKSSVTRCVDFRETAEVIAKVGFKMFLGVTASVSNWDTEGTCCSLILEDNPLVDFVELPDTCQGLYYCNILSGVVRGALEMVSMKTEVTWIKDMLRGDDAFELQVKLLKQVPEEYPYKDDE

SEQ ID NO: 7331 - protein, 186 aa, Eucalyptus grandis
MPTVGPRSGDAIFAKVERVNAELFTLTYGAIVRQLLTDLEDVEEVNKQLDQMGYNIGTRLIDEFLAKANISRCVDFKETAEMIAKVGFKMFLGVTASVTNWDIEGTCCNMVLEENPLVDFVELPDTCQGLYYCNVLCGVIRGALEMVSMKTEVTWVRDVLRGDDSYELQVKLLKQVPEEYPYKDDE

SEQ ID NO: 7332 - protein, 186 aa, Valeriana officinalis
MAPIAPRSGDAIFANIERVNAELFTLTYGAIVRQLLTDLEDVEEVNKQLDQMGYNIGIRLIDEFLAKSYISRCVDFKETAEVIAKVGFKMFLGVTASVSNWDSEGTCCSLILEDNPLVDFVELPDTYQGLYYCNILSGVVRGALEMVSMKTEVTWIRDMLRGDDAFEMQLKLIKQVPEEYPYKDDE

SEQ ID NO: 7333 - protein, 186 aa, Arabidopsis lyrata
MAPVGPRSGDAIFSSIDRVNAELFTLTYGAIVRQLLTDLEEVEEVNKQLDQMGYNIGIRLIDEFLAKSGVSRCVDFKETAEMIAKVGFKMFLGVTASVTSWDADGTCCSIILEDNPLVDFVELPDTCQGLYYCNILSGVIRGALEMVSMKTEVTWTRDVLRGDDAYELQVKLLKQVAEEYPYKDDE

SEQ ID NO: 7334 - protein, 186 aa, Cleome spinosa
MAPAGPRSGDAIFSSIERVNSELFTLTYGAIVRQLLTDLEEVEEVNKQLDQMGYNIGIRLIDEFLAKSGVSRCVDFKETAEVIAKVGFKMFLGVTASVTNWDADGTCCSIILEDNPVVDFVELPDTCQGLYYCNILSGVVRGALEMVSMKTEVTWIRDVLRGDDAYELQVKLLKQVAEEYPYKDDE

SEQ ID NO: 7335 - protein, 186 aa, Curcuma longa
MAPLVPKSGDAIFASIDRVNAELFTLTYGAMVRQLLTDLEEVDVVNKQLDQMGYNIGVRLIDEFLAKSNVSRCVDFKETADVIAKVGLKMFLGVTASVSNWDPEGSSFSLVLDDNPLVDFVELPDTFQGLHYCNILSGVIRGALEMVSMKTEITWIRDMLHGDDAYELRVKLLKQIPEEYPYKDDE

SEQ ID NO: 7336 - protein, 186 aa, Lactuca sativa
MAPAVPRSGDAIFANVERVNSELFTLTYGAIVRQLLTDLEEVEEVNKQLDQMGYNIGIRLIDEFLAKSNVTRCVNFRETAEVIAKVGFKMFLGVTASVINWDSEGTSCSLILEDNPLIDFVELPDTCQGLYYCNILSGVVRGALEMVSMKTEITWVRDMLKGDDAFELQVKLLKQVPEEYPYKDDE

SEQ ID NO: 7337 - protein, 186 aa, Tropaeolum majus
MPPVIPRSGDAIFANVERVNAELFTLTYGAIVRQLITDLEEVEEVNKQLDQMGYNIGIRLIDDFLAKSNVSRCVDFRETAEMIAKVGFKMFLGVTASVTNWDADGTCCSIILDDNPLADFVELPETCQGLYYCNVLSGVIRGALEMVSMKTEVTWVRDLLRGDDAYELQVKLLKQVPEEYPYKDDE

SEQ ID NO: 7338 - protein, 186 aa, Arachis hypogaea
MPPVAPRSGDSIFANLEHMNAELFTLTYGAIVRQLITDLEEVDEVNKQLDQMGYNIGVRLIDEFLAKSNISRCVDFKETAEVIAKVGFKMFLGVTASVINWDADGTSCSIVLEDNPLVDFVELPDNCQGLHYCNILSGVVRGALEMVSMKTEVTWVRDMLRGDEVYELNVKLIKQVPEEYPYKDDE

SEQ ID NO: 7339 - protein, 186 aa, Glycine max
MPPVAPRSGDAIFANVERVNAELFTLTYGAIVRQLLTDLEEVEEVNEQLDQMGYNIGIRLIDEFLAKSNVSRCNDFRETTDVIAKVGFKMFLGVTASVTNWDADGTCCSIVLEDNPLVDFVELPDNCQGLYYCNILSGVIRGALDMVSMKTEVTWLRDVLRGDDVFELQVKLLKHVPEEYPYKDDE

SEQ ID NO: 7340 - protein, 186 aa, Glycine max
MPPVAPRSGDAIFANVERVNAELFTLTYGAIVRQLLTDLEEAEEVNKQLDQMGYNIGIRLIDEFLAKSNVSRCNDFRETTDVIAKVGFKMFLGVTASVTNWDADGTCCSIVLEDNPLVDFVELPDNCQGLYYCNILSGVIRGALDMVSMKTEVTWLRDVLRGDDVFELQVKLLKHVPEEYPYKDDE

SEQ ID NO: 7341 - protein, 186 aa, Solanum lycopersicum
MAPVVPRSGDAIFANVERVNAELFTLTYGAIVRQLLTDLEEVDEVNKQLDQMGYNIGIRLIDEFLAKSNVSRCVDFKETAEVIAKVGLKMFLGVTATVTNWNVEGTTCSLILEDNPLVDFVELPDTCQGLYYCNILSGVVRGALEMVSMKTEVTWLRDMLRGDDAFELQLKLLRQVPEEYPYKDDE

SEQ ID NO: 7342 - protein, 186 aa, Trigonella foenum-graecum
MAPVAPRSGDAIFANIERVNAELFTLTYGAIVRQLITDLEEVEEVNKQLDQMGYNIGIRLIDEFLAKSNVSSCVDFRETAEVIAKVGFKMFLGVTASVTNWDAEGTCCSIVLEDNPLVDFVELPDNYQGLHYCNILSGVIRGALDMVSMKAEVTWLRDALRGDDVFELQVKLLKQVPEEYPYKDDE

SEQ ID NO: 7343 - protein, 186 aa, Arabidopsis thaliana
MAPVGPRSGDAIFSSIDRVNAELFTLTYGAIVRQLLTDLEEVEEVNKQLDQMGYNIGIRLIDEFLAKSGVSRCVDFKETAEMIAKVGFKMFLGVTASVTSWDSDGTCCSIILEDNPLVDFVELPDTCQGLYYCNVLSGVIRGALEMVSMKTEVTWTRDVLRGDDAYELQVKLLKQVAEEYPYKDDE

SEQ ID NO: 7344 - protein, 186 aa, Cleome gynandra
MAPVGPRSGDAIFSSIERVNAELFTLTYGAIVRQLLTDLEEVEEVNKQLDQMGYNIGIRLIDEFLAKSGVSRCVDFKETAEVIAKVGFKMFLGVTASVTNWDADGTCCSIILEDNPLIDFVELPDTCQGLYYCNILSGVIRGALEMVSMKTEVTWIRDALRGDDAYELQVKLLKQIAEEYPYKDDE

SEQ ID NO: 7345 - protein, 186 aa, Vigna unguiculata
MPPVAPRTGDAIFANIERVNAELFTLTYGAIVRQLLTDLEEVEEVNKQLDQMGYNIGIRLIDEFLAKSNVSRCNDFRETTDVIAKVGFKMFLGVTASVTNWDADGTCCSIVLEDNPLVDFVELPDNCQGLYYCNILSGVIRGALDMVSMKTEVTWLRDVLRGDDVFELQVKLVKHVPEEYPYKDDE

SEQ ID NO: 7346 - protein, 186 aa, Cycas rumphii
MAPLVPRSGDAVFANVERVNAELFTLTYGAIVRQLLTDFEEVDEVNKQLDQMGYNIGIRLIDEFLAKSNVTRCVDFKETTEVIAKVGFKMFLGVTASVTNWDADGTECSLILEDNPLVDFVELPETCQGLYYCNVLCGVIRGALEMVSMKTEVRWVRDMLRGDDAYELKLKLLKQVPEEYPYKDDE

SEQ ID NO: 7347 - protein, 186 aa, Medicago truncatula
MAPVAPRTGDAIFANIERVNAELFTLTYGAIVRQLLTDLEEVDEVNKQLDQMGYNIGIRLIDEFLAKSNVSRCVDFRETADVIAKVGFKMFLGVTASVTNWDAEGTTCSIILEDNPLVDFVELPDNYQGLYYCNILSGVIRGALDMVSMKAEVTWLRDALRGDDVFELQVKLLKQVPEEYPYKDDE

SEQ ID NO: 7348 - protein, 177 aa, Eschscholzia californica
GDAVFANVERVNAELFTLTYGAMVRQLLTDLEEVEEVNKQLDQMGYNIGIRLIDEFLAKSNVSRCVDFRESADAIAKVGFKMFLGVTATVTIGMPRTSCSLVLDENPLVDFVELPDTCQGLYYCNVLSGVIRGALEMVSMKTEVTWVRDMLRGDDAYELRVKLLKQVPEEYPYKDDE

SEQ ID NO: 7349 - protein, 186 aa, Picea glauca
MAPLAPRSGDAVFANVERVNAELFTLTYGAIVRQLLTDFEEVEEVNKQLDQMGYNIGIRLIDEFLAKSNITRCVDFKETAEVIAKVGFKMFLGVTASVGNWDADGTECSLILEDNPLVDFVELPETCQGLYYCNVLCGVIRGALEMVSMKTEVRWVRDMLCGDDAYELKLKLLEQVPEEYPYKDDE

SEQ ID NO: 7350 - protein, 186 aa, Unknown
  Sequence found in Organisms: Thellungiella halophila, Eutrema halophilum
MAPVGPRSGDAIFSSIDRVNAELFTLTYGAIVRQLLTDLEEVEEVNKQLDQMGYNIGIRLIDEFLAKSGVSRCVDFRETAEMIAKVGFKMFLGVTASVSSWDADGTCCSIILEDNPLVDFVELPDTCQGLYYCNVLSGVIRGALEMVSMKTEVTWTRDVLRGDDAYELQVKLLKQVAEEYPYKDDE

SEQ ID NO: 7351 - protein, 186 aa, Cajanus cajan
MAPVAPRTGDAIFANVERVNAELFTLTYGAIVRQLLTDLEEVEEVNKQLDQMGYNIGIRLIDEFLAKSNVSRCNDFRETTDVIAKVGFKMFLGVTASVTNWDADGTCCSIVLEDNPLVDFVELPDNCQGLYYCNILSGVIRGALDMVSMKTEVTWLRDVLRGDDVFELQVKLLKHVPEEYPYKDDE

SEQ ID NO: 7352 - protein, 186 aa, Rhizophora mangle
MAPVGPRSGDAIFASVERVNAELFTLTYGAIVRQLLTDLEEVEEVNKQLDQMGYNIGIRLIDEFLAKSHVSRCVDFRETAEVIAKVGFKMFLGVSASVTNWDSDGTCCSIIFEDNPLVDFVELPDTCQGLHYCNVLSGVIKGALEMVSMKTEVTWVRDMLRGDDAFELQLKLLKQAPEEYPYKDDE

SEQ ID NO: 7353 - protein, 172 aa, Rhizophora mangle
MAPVGPRSGEAIFASVERVNAELFTLTYGAIVRQLLTDLEEVEEVNKQLDQVGYNIGIRLIDEFLARSNVSRCVDFRETAEVIAKVGFKMFLGVSASVTNWDADGTCCSIILEDNPLVDFVELPDTCQGLYYCNVLSGVIRGALEMVSMKTEVTWLRDMLRGDDQFELQVNF

SEQ ID NO: 7354 - protein, 186 aa, Abies balsamea
MAPIVPRSGDAVFANVERVNAELFTLTYGAIVRQLLTDFEEVEEVNKQLDQMGYNIGIRLIDEFLAKSNIARCVDFKETAEVIAKVGFKMFLGVTASVANWDADGTECSLILEDNPLVDFVELPETCQGLYYCNVLCGVIRGALEMVSMKTEVRWVRDMLCGDDAYELKLKLLEQVPEEYPYKDDE

SEQ ID NO: 7355 - protein, 186 aa, Unknown
  Sequence found in Organisms: Brassica napus, Brassica juncea, Brassica oleracea, Brassica rapa, Raphanus sativus
MAPVGPRSGDAIFSSIDRVNAELFTLTYGAIVRQLLTDLEDVDEVNKQLDQMGYNIGIRLIDEFLAKSGVSRCVDFKETAEMIAKVGFKMFLGVTASVSSWDADGTCCSIILEDNPLVDFVELPDTCQGLYYCNVLSGVIRGALEMVSMKTEVTWTRDALRGDDAYELQVKLLKQVAEEYPYKDDE

SEQ ID NO: 7356 - protein, 186 aa, Pinus taeda
MAPLVPRSGDAVFANVERVNAELFTLTYGAIVRQLLTDFEEVEEVNKQLDQMGYNIGIRLIDEFLAKSNITRCVDFKETAEAIAKVGFKMFLGVTASVTNWDADGTECSLILEDNPLVDFVELPETCQGLYYCNVLCGVIRGALEMVSMKTEVRWVRDMLSGDDAYELKLKLLEQVPEEYPYKDDE

SEQ ID NO: 7357 - protein, 159 aa, Cynodon dactylon
RGGLVRQLLTDLEEVEEVNKQLDQMGYNIGTRLVDEFLAKSNVSRCVDFKETADVIAKLGFKMFLGVTATVTNWDAEGTTCSFVLEDNPLVDFVELPDTCQGLQYCNVLSGVIRGALEMVSMKTEVTWVRDMLRGDDAYEMRVKLIKQVPEEYPYKDDD

SEQ ID NO: 7358 - protein, 113 aa, Flaveria ramosissima
MAPAVPRSGDAIFANVERVNAELFTLTYGAIVRQLLTDLEEVEEVNKQLDQMGYNIGIRLIDEFLAKSNVTRCVDFRETAEVIAKVGFKMFLGVTASVTNWDTEGTSCSLNFG

SEQ ID NO: 7359 - protein, 188 aa, Cynara scolymus
GLHGSRRSRSGDAIFANVERVNSELFTLTYGAIVRQLLTDLEEVEEVNKQLDQMGYNIGIRLIDEFLAKSNVTRCVDFRETAEVIAKVGFKMFLGVTASVTNWDAEGTCCSLILDDNPLVDFVELPDTCQGLYYCNILSGVVRGALEMVSMKTEITWIRDMLRGDDAFELQVKLLKQVPEEYPYKDDE

SEQ ID NO: 7360 - protein, 186 aa, Pinus pinaster
MAPLVPRSGDAVFANVERVNAELFTLTYGAIVRQLLTDFEEVEEVNKQLDQMGYNIGIRLIDEFLAKSNITRCVDFKETAEAIAKVGFKMFLGVTASVANWDADGTECSLILEDNPLVDFVELPETCQGLYYCNVLCGVIRGALEMVSMKTEVRWVRDMLCGDDAYELKLKLLEQVPEEYPYKDDE

SEQ ID NO: 7361 - protein, 186 aa, Eutrema parvulum
MAPVGPRSGDAIFSSIDRVNAELFTLTYGAIVRQLLTDLEEVEEVNKQLDQMGYNIGIRLIDEFLAKSGVSRCVDFKETAEMIAKVGFKMFLGVTASVSSWDVDGTCCNIILEDNPLVDFVELPDNCQGLYYCNVLSGVIRGALEMVSMKTEVTWTRDVLRGDDAYELQVKLLKQVAEEYPYKDDE

SEQ ID NO: 7362 - protein, 186 aa, Medicago truncatula
MAPVAPRSGDAIFANIEHVNAELFTLTYGAIVRQLLTDLEEVDEVNKQLDQMGYNIGIRLIDEFLAKSNVSSCVDFRETAEVIAKVGLKMFIGVTASVTNWNAEGTCCSIVLEDNPLVDFVELPDTYQGLHYCNILSGVIRGALDMVSMKAEVTWLRDALRGDDVFELQVKLLKQVPEEYPYKDDE

SEQ ID NO: 7363 - protein, 169 aa, Vinca minor
MAPVAPRSGDAIFASVERVNAELFTLTYGAIVRQLLTDLEEVEEVNKQLDQMGYNIGIRLIDEFLAKSNVSGCVDFKETAEVIAKVGFKMFLGVTATVTNWDAEGTTCSLILEDNPLVDFVELPDTCQGLYYCNILSGVIRGALEMVSMKTEVTWIRDMLRGDDAYEMQ

SEQ ID NO: 7364 - protein, 186 aa, Gnetum gnemon
MAPLVPRSGDAAFANVERVNAELFTLTYGAIVRQLLTDFEEVDQVNKQLDQMGYNIGIRLIDEFLAKSNVTRCVDFKETAEVIAKVGFKMFLGVTANVTNWDSDGTECSLILEDNPLVDFVELPDNCQGLYYCNILCGVIRGALEMVSMKTEVKWVRDMLRGDEAYELRLKLLEQVPEVYPYKDEE

SEQ ID NO: 7365 - protein, 178 aa, Podocarpus macrophillus
GDAVFANVERVNAELFTLTYGAIVRQLLTDFEEVEEVNKQLDQMGYNIGIRLIDEFLAKANVSRCVDFKETSEVIAKVGFKMFLGVTANVTNWDVDGTECSLILEDNPLVDFVELPETCHGLYYCNVLCGVIRGALEMVSMKTEVRWVRDMLRGDDAYELKLKLLEQVPEEYPYKDED

SEQ ID NO: 7366 - protein, 186 aa, Cryptomeria japonica
MSRLVPRAGDAVFANVERVNAELFTLTYGAIVRQLLTDFEEVEEVNKQLDQMGYNIGIRLIDEFLAKANVARCVDFKETTDVIAKVGFKMFLGVTATVANWDADGTECSLILEDNPLVDFVELPETCHGLYYCNVLCGVIRGALEMVSMKTEVRWVRDVLRGDDAYELKLKLLEQVPEEYPYKDEE

SEQ ID NO: 7367 - protein, 177 aa, Ipomoea nil
MAPVAPRSGDAIFANVERVNAELFTLTYGAIVRQLLTDLEEVDEVNKQLDQMGYNIGVRLIDEFLAKSNVSRCVDFKETAEVIAKVGFKMFLGVTATVSNWDADGTTCSLILEDNPLVDFVELPDTCQGLYYCNILSGVVRGALEMVSMKTEVTWIRDMLRGDDVFELQLKLLKQVP

SEQ ID NO: 7368 - protein, 186 aa, Sciadopitys verticillata
MARLVPRAGDAVFANVERVNAELFTLTYGAIVRQLLTDFEEVEEVNKQLDQMGYNIGIRLIDEFLAKANVARCVDFKETAEVIAKVGFKMFLGVTASVTNWDADGTECSIILEDNPLVDFVELPETCHGLYYCNVLCGVIRGALEMVSMKTEVRWVRDILRGDDAYELKLKLLEQVPEEYPYKDDE

SEQ ID NO: 7369 - protein, 186 aa, Cephalotaxus harringtonia
MARLVPKAGDAVFANVERVNAELFTLTYGAIVRQLLTDFEEVEEVNKQLDQMGYNIGIRLIDEFLAKANVARCVDFKETTEVIAKVGFKMFLGVTANVSNWDADGTECSLILEDNPLVDFVELPETCHGLYYCNVLCGVIRGALEMVSMKTEVRWVRDILRGDDAYELKLKLLEQVPEEYPYKDEE

SEQ ID NO: 7370 - protein, 186 aa, Taxus baccata
MARLVPRAGDAVFANVERVNAELFTLTYGAIVRQLLTDFEEVEQVNKHLDQMGYNIGIRLIDEFLAKANVARCVDFKETTEVIAKVGFKMFLGVTASVANWDADGTECSLILEDNPLVDFVELPETCHGLYYCNVLCGVIRGALEMVSMKTEVRWVRDMLRGDDAYELKLKLIEQVPEEYPYKDDE

SEQ ID NO: 7371 - protein, 156 aa, Eragrostis curvula
MVRQLLTDLEEVEEVNKQLDQMGYNIGTRLVDEFLAKSNVSRCDDFKETADVIAKLGFKMFLGVTATVTNWDAEGTTCSFILEDNPLVDFVELPDTCQGLQYCNVLSGVIRGSLEMVSMKTEVTWVRDMLRGDDAYEMRVKLIKQVPEEYPYKDDD

SEQ ID NO: 7372 - protein, 153 aa, Panicum virgatum
QLLTDLEEVEEVNKQLDQMGYNIGTRLIDEFLAKSNVSRCVDFKETADVIAKLGFKMFLGVTATVTNWDAEGTSCSFILEDNPLVDFVELPDTCQGLQYCNVLSGVIRGALEMVSMKTEVTWVRDMLRGDDAYEMRVKLIKQVPEEYPYKDDD

SEQ ID NO: 7373 - protein, 169 aa, Zostera marina
MQNAELFTLTYGAIVRQLLTDLEDVDEVNKQLDQMGYNIGIRLIDEFLAKSNVSRCVNFKETAEVIAKVGFKMFLGITATVTNWDVDGSSCSLVLEDNPLVDFVELPDMCQGLYYCNVLSGVIRGALEMVSMKTEVTWVRDMLRGDDAYELRLKLLKQVPEEYPYKDDE

SEQ ID NO: 7374 - protein, 172 aa, Saccharum officinarum
MNRKPGDWDCRACQHLNFSRRDICQRCSEPRGVTDRGSGGGGDYANFGGRGGSSFGGGFGAGSDVRPGDWYCSCGAHNFASRSSCFKCSAYKEEAAVNSGAGGFDSDMSRSRGYGFGSGAARTNRPGWKSGDWICTRSGCNEHNFASRMECFRCNAPRDSGSAAMTYENYLH

SEQ ID NO: 7375 - protein, 172 aa, Sorghum bicolor
MNRKPGDWDCRSCQHLNFSRRDICQRCSEPRGVADRGSGGGGDYANFGGRGGSSFGGGFGAGSDVRPGDWYCSCGAHNFASRSSCFKCSAYKEEAAVNSGAGGFDSDMSRSRGYGFGSGAARTNRPGWKSGDWICTRSGCNEHNFASRMECFRCNAPRDSGSAAMTYENYLH

SEQ ID NO: 7376 - protein, 164 aa, Sorghum bicolor
MNRKPGDWDCRSCQHLNFSRRDICQRCSEPRGVADRGSGGGGDYANFGGRGGSSFGGGFGAGSDVRPGDWYCSCGAHNFASRSNCFKCSAYKEEAAVNSGAGGFDSDMSRSRGYGFGSGAARTNRPGWKSGDWICTRSGCNEHNFASRMECFRCNAPRDSGTEA

SEQ ID NO: 7377 - protein, 182 aa, Zea mays
MNRKPGDWDCRACQHLNFSRRDICQRCSEPRGVADRGGGGGGGDYASFGGRGGSSFGGGFGAAGSDVRPGDWYCSCGAHNFASRSSCFKCSAYKEEAAVNSGAGGFDGDMSRSRGYGFGSGAAGAGAGAARTTNRPGWKSGDWICTRSGCNEHNFASRMECFRCNAPRDSGSAAMTYENYLH

SEQ ID NO: 7378 - protein, 172 aa, Setaria italica
MNRKPGDWDCRACQHLNFSRRDLCQRCGEPRGAADRGSGGGGDYANFGGRGGSSFGGGFGAGSDVRPGDWLCNCGAHNFASRSNCFKCSAFKEEAAVNSGAGGFDGDMSRSRYSFGGGAARTNRPGWKSGDWICTRSGCNEHNFASRMECFRCNAPRDSGSAAMTYDNYNLH

SEQ ID NO: 7379 - protein, 178 aa, Pennisetum glaucum
MNRKPGDWDCRACQHLNFSRRDLCQRCGEPRGAADRGSGGGGDYANFGGRGGSSFGGGFGAGSDVRPGDWLCNCGAHNFASRSNCFKCSAFKEEAAVNSGAGGFDGDMSRSRYGFGGGMGGGGGAARTNRPGWKSGDWICTRSGCNEHNFASRMECFRCNAPRDSGSAAMTYDNYNLH

SEQ ID NO: 7380 - protein, 163 aa, Panicum virgatum
MNRKPGDWDCRACQHLNFSRRDLCQRCGEPRGAADRGSGGGGDYANFGGRGGSSFGGGFGAGSDVRPGDWLCSCGAHNFASRSNCFKCSAFKEEAAVNSGAGGFDGDMSRSRYGFGGGAARTNRPGWKSGDWICTRSGCNEHNFASRMECFRCNAPRDSGTEV

SEQ ID NO: 7381 - protein, 163 aa, Panicum virgatum
MNRKPGDWDCRACQHLNFSRRDLCQRCGEPRGAADRGSGGGGDYANFGGRGGSSFGGGFGAGSDVRPGDWLCSCGAHNFASRSNCFKCSAFKEEAAVNSGSGGFDGDMSRSRYGFGGGAARTNRPGWKSGDWICTRSGCNEHNFASRMECFRCNAPRDSGTEV

SEQ ID NO: 7382 - protein, 204 aa, Saccharum officinarum
MADAVQRLKSGFNKFKTEVYDKKPELFEPLKAGQSPKYMVFACADSRVCPSVTLGLQPGEAFTVRNIAAMVPAYDKTKYTGIGSAIEYAVCALKVEVLVVIGHSCCGGIRALLSLQDGAPDNFHFVEDWVRIGFPAKVKVKKEHASVPFDDQCSILEKEAVNVSLENLKTYPFVKEGLANGTLRLVGGHYNFVSGEFHTWEIKS

SEQ ID NO: 7383 - protein, 204 aa, Sorghum bicolor
MADAVDRLKTGFNKFKTEVYDKKPELFEPLKAGQSPKYMVFACSDSRVCPSVTLGLQPGEAFTVRNIAAMVPAYDKTKYTGIGSAIEYAVCALKVQVLVVIGHSCCGGIRALLSLQDGAPDTFHFVEDWVRIGFPAKIKVKKEHASVPFDDQCSILEKEAVNVSLDNLKTYPFVKEGLANGTLRLVGGHYNFVSGEFDTWEIKS

SEQ ID NO: 7384 - protein, 202 aa, Zea mays
MGDAVEHLKSGFQKFKTEVYDKKPELFEPLKAGQAPKYMVFACSDSRVCPSVTLGLQPGEAFTVRNIAAMVPAYDKTKYTGIGSAIEYAVCALKVEVLVVIGHSCCGGIRALLSLQDGAPDNFHFVENWVKIGFPAKVKVKKEHASVPFDDQCSILEKEAVNVSLENLKTYPFVQEGLAKGTLKLVGAHYDFVSGNFLVWET

SEQ ID NO: 7385 - protein, 668 aa, Sorghum bicolor
MSAFPVRGSTSSSSIVASLGSSRAPAPAPSSVRRRPSLIRNAPVVAVPATLVGMDAVERLKVGFQKFKTEVYDKKPELFEPLKAGQAPKYMVFACSDSRVCPSVTLGLQPGEAFTVRNIASMVPPYDKTKYSGTGSAIEYAVCALKVQVLVVIGHSCCGGIRALLSLKDGAPHNFHFVEDWVRIGSPAKAKVHKEHASVPFDDQCSILEKEAVNVSLANLKTYPFVKERLAKGTLKLVGAHYDFVSGKFLTWEPVMDAVDRLKSGFEQFKIEVYDKKPELFEPLKSGQAPRYMVFACADSRVCPSVTLGLMPGEAFTVRNIAALVPGYDKTKYTGIGSAIEYAVCALKVQVLVVIGHSCCGGIRALLSLQDGAPDNFHFVEDWVKIGFPAKMKVKKENASVPFDDQCYILEKEAVNVSLENLKTYPFVKEGLANGTLKLVGGHYDFVKGEFLTWKDMADAVDRLKTGFNKFKTEVYDKKPELFEPLKAGQSPKYMVFACSDSRVCPSVTLGLQPGEAFTVRNIAAMVPAYDKTKYTGIGSAIEYAVCALKVQVLVVIGHSCCGGIRALLSLQDGAPDTFHFVEDWVRIGFPAKIKVKKEHASVPFDDQCSILEKEAVNVSLDNLKTYPFVKEGLANGTLRLVGGHYNFVSGEFDTWEIKRTWRTPSSA

SEQ ID NO: 7386 - protein, 456 aa, Sorghum bicolor
MSAFPVRGSTSSSSIVASLGSSRAPAPAPSSVRRRPSLIRNAPVVAVPATLVGMDAVERLKVGFQKFKTEVYDKKPELFEPLKAGQAPKYMVFACSDSRVCPSVTLGLQPGEAFTVRNIASMVPPYDKTKYSGTGSAIEYAVCALKVQVLVVIGHSCCGGIRALLSLKDGAPHNFHFVEDWVRIGSPAKAKVHKEHASVPFDDQCSILEKEAVNVSLANLKTYPFVKERLAKGTLKLVGAHYDFVSGKFLTWEPVMDAVDRLKSGFEQFKIEVYDKKPELFEPLKSGQAPRYMVFACADSRVCPSVTLGLMPGEAFTVRNIAALVPGYDKTKYTGIGSAIEYAVCALKVQVLVVIGHSCCGGIRALLSLQDGAPDNFHFVEDWVKIGFPAKMKVKKENASVPFDDQCYILEKEAVNVSLENLKTYPFVKEGLANGTLKLVGGHYDFVKGEFLTWKV

SEQ ID NO: 7387 - protein, 452 aa, Zea mays
MSSCLCLPKKKEGPAKEKPSTDTPTSSLLQNQKPSQPPPPPSKASSKGMDPTVERLKSGFQKFKTEVYDKKPELFEPLKSGQSPRYMVFACSDSRVCPSVTLGLQPGEAFTVRNIASMVPPYDKIKYAGTGSAIEYAVCALKVQVIVVIGHSCCGGIRALLSLKDGAPDNFHFVEDWVRIGSPAKNKVKKEHASVPFDDQCSILEKEAVNVSLQNLKSYPFVKEGLAGGTLKLVGAHYDFVKGQFVTWEPPQDAIERLTSGFQQFKVNVYDKKPELFGPLKSGQAPKYMVFACSDSRVCPSVTLGLQPGEAFTVRNIAAMVPGYDKTKYTGIGSAIEYAVCALKVEVLVVIGHSCCGGIRALLSLQDGAPDTFHFVEDWVKIGFIAKMKVKKEHASVPFDDQCSILEKEAVNVSLENLKTYPFVKEGLANGTLKLIGAHYDFVSGEFLTWKK

SEQ ID NO: 7388 - protein, 200 aa, Saccharum officinarum
DAVERLKSGFEQFKIEVYDKKPDLFEPLKSGQAPRYMVFACADSRVCPSVTLGLLPGEAFTVRNIAAMVPGYDKTKYTGIGSAIEYAVCALKVQVLVVIGHSCCGGIRALLSLQDGAPDNFHFVEDWVKIGFPAKMKVKKEHASVPFDDQCYILEKEAVNVSLENLKTYPFVKEGLAKGTLKLVGGHYDFVRGEFLTWKV

SEQ ID NO: 7389 - protein, 322 aa, Saccharum officinarum
MSSCLCLPKKKEGAAKPSIDSTTTSVVQNPKPTQPPPPPSKGMDAVERLKVGFQKFKTEVYDKKPELFEPLKGGQAPKYMVFACADSRVCPSVTLGLQPGEAFTVRNIAAMVPPYDKTKYSGTGSAIEYAVCALKVEVLVVIGHSCCGGIRALLSLKDSAPDNFHFVEDWVRIGSPAKTKVQKEHASVPFDDQCSILEKEAVNVSLANLKTYPFVKERLAKGTLKLVGGHYDFVSGKFVTWEPVTDAVERLKSGFEQFKIEVYDKKPDLFEPLKSGQAPRYMVFACADSRVCPSVTLGLLPGEAFTVRNIAAMVPGYEKTKY

SEQ ID NO: 7390 - protein, 246 aa, Setaria italica
MSGCLCLPKKKEGVSAAKQSINSPASSLLQNQKPTQPPPPPSKKGMDAVERLKSGFDKFKTDVYDKKPELFEPLKEGQAPRYMVFACSDSRCCPSVTLGLQPGEAFTVRNIAAMVPPYDKTKYTGIGSAIEYAVCALKVEVLTVIGHSRCGGIKALLSLQDGEADKFHFVEDWVRIGAPAKAKVQADHASAAFEDQCSILEKEAVNVSLENLKTYPFVKEGLEKGTLKLVGGHYDFVSGKFETWEP

SEQ ID NO: 7391 - protein, 246 aa, Setaria italica
MSGCLCLPKKKEGVSAAKQSINSPASSLLQNQKPTQPPPPPSKKGMDAVERLKSGFDKFKTDVYDKKPELFEPLKEGQAPRYMVFACSDSRCCPSVTLGLQPGEAFTVRNIAAMVPPYDKTKYTGIGSAIEYAVCALKVEVLTVIGHSRCGGIKALLSMKDGAPDNFHFVEDWVRIGFLAKKKVLTNHASVPFDDQCTLLEKEAVNVSLYNLLTYPWVKEGVANGTLKLVGGHYDFVNGVFSVWEK

SEQ ID NO: 7392 - protein, 202 aa, Setaria italica
MADAVERLKTGFEQFKADVYDKKPELFEPLKAHQSPKYMVFACSDSRVCPSVTLGLQPGEAFAVRNIASMVPPYDKTKYAGVGSAIEYAVCALKVEVIVVIGHSCCGGIKALLSLQDGEADKFHFVEDWVRIGAPAKAKVQADHASAAFEDQCSILEKEAVNVSLENLKTYPFVKEGLEKGTLKLVGGHYDFVSGKFETWEP

SEQ ID NO: 7393 - protein, 257 aa, Brachypodium distachyon
MSTAAANWCYATVAPRAKSVVVASLGTPAPSSSGSFRPRLIRNAPVQAAPVAPALMDAAVERLKTGFEKFKTEVYDKKPDVFEPLKAGQAPKYMVFACADSRVCPSVTLGLEPGEAFTVRNIANMVPSYCKNKYAGVGSAIEYAVCALKVEVIVVIGHSRCGGIKALLSLKDGADDSFHFVEDWVRIGFPAKKKVQTECASMPFDDQCAVLEKEAVNVSLENLKTYPFVKEGVANGTLKLVGGHYDFVSGKFDTWEL

SEQ ID NO: 7394 - protein, 229 aa, Panicum virgatum
AKQSLPQSSSILPQLAPPALLYSPKDAMADAVERLKAGFEQFKADVYDKKPEVYEPLKAHQSPKYMVFACSDSRVCPSVTLGLQPGEAFAVRNIASMVPPYDKTRYAGVGSAIEYAVCALKVEVIVVIGHSRCGGIKALLSLQDGEPDKFHFVEEWVRIGAPAKTKVQADHASAPFEDQCSALEKEAVNLSLENLKTYPFVKEGLEKGTLKLVGGHYDFVSGKFETWDP

SEQ ID NO: 7395 - protein, 272 aa, Saccharum officinarum
MAFVSATAAAPATLFLSVLSAPQGAGACVLPQRLQPFLAPLHAAKGPNSAPVVLESKAKGKKKKGSGAGNLAGALDVEIREAQEYLDSDEQDPVPDNFPFEIIDEEGMSVVILRRDYKDEKIEVTVSMPNLDGGPEFDDEDGEGDGESAVKDDEEAEEDDESAGDSSISLKVVVSKDSGPKLEFTCTAFREEITIDDMLIVEETEDDGEEKFPYEGPEFTELPVNVQKGLFKYLEQRGVTLPATNYMHDYMVTKQAQEYIRWMTKLKDFVKQ

SEQ ID NO: 7396 - protein, 272 aa, Sorghum bicolor
MAFVSATAAASTTLFLSVLSPARSAGACVCSQARKPSTAPLHAAKGPNSAPVVLESKAKGKKKKGSGAGNLAGALDVEIREAQEYLDSDEQEPLPDNFPFEIIDEDGMSVVILRRDYKDEKIEVTVSMPNLEGGPEFDDEDGEGDGESAGKDDEEAEEEDESAGDSSISLKVVVSKDSGPKLEFTCTAFREEITIDDMLIVEKTDDDGEEKFPYEGPEFTELPVNVQKGLFKYLEQRGVTLSATNYMHDYMVTKQAQEYIRWMTKLKDFVKQ

SEQ ID NO: 7397 - protein, 273 aa, Panicum virgatum
MAFVSVSASASATLLISVPSTGRTGAGACAFPQPRRTLLAPLHAAKGAKSVPVEVVMESKVKGKKKKGSGAGNLPGALDVEIREAQEYLNSDEQEPVPDNFPFEILDEDGMSVVILKRDYKDEKIEVVVSMPNLEGGPEFDDEDGEGDGESADKDDDEEEDESAGDSSISLKVVVSKASGPKLEFTCTAFREEITIDDMLIVEKADDDGEEKFPYEGPEFTELPVNVQKGLFKYLEQRGITLSATNYMHDYMVTKQAQEYIRWMRKLKDFVQQ

SEQ ID NO: 7398 - protein, 156 aa, Panicum virgatum
MAFVSASASATLLVSVPSTGRASAGVCACPQPRRTLLAPLHAAKGAKSVPVEVVMESKVKGKKKKGSGAGNLPGALDVEIREAQEYLDSDEQEPVPDNFPFEILDEDGMSVVILKRDYKDEKIEVVVSMPNLEGGPEFDDEDGEGDGESAGKDDDE

SEQ ID NO: 7399 - protein, 98 aa, Zea mays
MAFMRYRALPQGELTVEGFRAWLAQFDADRDGRISREELQHALRSLNVWFAWWKARGAVRAADADRDGGVQLIGEDEVARLFAFAQTHLHVKIAQLGY

SEQ ID NO: 7400 - protein, 97 aa, Setaria italica
MAFMRYRALPQGEPTVEEFRAWLAQFDADSDGRISREELQHALRSLNVWFAWWKARGGVRAADANHDGGVAGDDEVARLFAFAQRHLNVKITQLGYY

SEQ ID NO: 7401 - protein, 98 aa, Sorghum bicolor
MAFMRYRALPQGELTVEEFRAWLAQFDADRDGRISREELQHALRSLNVWFAWWKARDGVRAADANRDGGVQGDDEVARLFAFAQRQLHVKITQQLGYY

SEQ ID NO: 7402 - protein, 104 aa, Triticum aestivum
  misc_feature (87)..(87): Xaa can be any naturally occurring amino acid
  misc_feature (91)..(92): Xaa can be any naturally occurring amino acid
  misc_feature (98)..(99): Xaa can be any naturally occurring amino acid
  misc_feature (101)..(102): Xaa can be any naturally occurring amino acid
MAFMRYRALPRGELTAEEFRAWLAQFDADSDGRISREELRHALRSLNVRFAWWKAMGGVRAADADRDGGVQLGEDEVARLFAFAQSXLGVXXPSSGYXXYXXPS

SEQ ID NO: 7403 - protein, 97 aa, Setaria italica
MAFVRYRALPRGELTVEEFRAWLAQFDADRDGRISREELQHALQSLNVWFAWWKARGGVRAADANRDGGVAGEEEVARLFAFAQRNLHAKLTQLGYY

SEQ ID NO: 7404 - protein, 93 aa, Setaria italica
RYRALPKGEPTVEEFRAWLAQFDADSDGRISREELQHALRSLNVWFAWWKARGGVRAADANHDGGVAGDDEVARLFAFAQRHLNVKITQLGYY

SEQ ID NO: 7405 - protein, 135 aa, Oryza sativa
ALSSQVRLPMSLRVATAPAPARVSVLPASNKLGDRLRMQATYNVKLITPDGEVELQVPDDVYILDQAEEEGIDLPYSCRAGSCSSCAGKVVSGEIDQSDQSFLDDDQVAAGWVLTCHAYPKSDVVIETHKEDDLI

SEQ ID NO: 7406 - protein, 137 aa, Setaria italica
MATALSSLRAPAFSVRAAPAPAPATVALPAKVARGARLRAQATYNVKLITPDGEVELQVPDDVYILDQAEEDGIDLPYSCRAGSCSSCAGKVVSGSVDQSDQSFLDDGQVAAGWVLTCHAYPTSDVVIETHKEEELI

SEQ ID NO: 7407 - protein, 139 aa, Pennisetum glaucum
MATALSSSLRAPAFSVRAAPAPAPATVALPAAKLARGTRLRAQAVHNVKLITPDGEVELQVPDDVYILDQAEEEGIDLPYSCRAGSCSSCAGKVVSGSVDQSDQSFLDDDQVSAGWVLTCAAYPTSDVVIETHKEEDLI

SEQ ID NO: 7408 - protein, 134 aa, Setaria italica
MATALSSLRAPAFSVRAAPAPAPATVALPAKVARGARLRAQATYNVKLITPDGEVELQVPDDVYILDQAEEDGIDLPYSCRAGSCSSCAGKVVSGSVDQSDQSFLDDGQVAAGWVLTCHAYPTSDVVIETHKEE

SEQ ID NO: 7409 - protein, 1702 aa, Oryza sativa
MASYSGEFFVGEAGIFGVRCFCHRLRMSVAKFCEHSGGPAEKAGEIVIMDNGMTIVQWLKYCMGVGASISDTKWDWPEWAYMRYSSEEYWTKSLLTTNNNMEKTGLFSGHGKSTGHINNPVYSSDIHNEVGRFTSVEKLVNKPDETFYRKSVGLHEAFSKNPAIQQSSKINLANHMIHDMNMNSISRPSERTYSTANMGITYSRNHLAHDYANFLEKNLNNLSRSPGPSSTRVLSNDSRACMPDVPHKIIQDGSGRASNTELKLGQSSYHQSMATLFPSVQSTIIEFQKPQHHLQFTTPNAYPKQTTKANKTIENIEPSFGTGNRKRSLDVSNGTSHSELNEITDDAAKNSFISLFLSHLERNSTSESIDDVLNSNEHYLLKAPDVAYSSDRLKTASTQVETRANDNQLKLAPAIIHTKRISDSRSLPVPVASKGYVHQDVLHANSQEPLINGDCLPHLLPSQPNAGISKICAEVSSPVNCRCCNHVADKSHLAHSETGAPCFYDRTARRYISFECADDLCTHKSLRATNYQCGRAFCSTANEFLPSFGQNDQSPIGKSMHRCCCKAQEDSSKLGFRAGNFCRSHFCNDGTPVPAHRSIVEGLDEVRTRSTFIPRSSLCSRELMLQSCCHACPIDGYYRSSMGHTANSLTKNTLLDAPNNTECSPYRDGKCCCSLAPKCLAGYGFTKHCVARIDQTDHTVQKSKDDGMQAAARCCTLGESEKLICQCSSEIIARKSDSKASFQNEVSTEVLNRPCVPTLQQLKNVTEASAVGGHWPYETVKEKASACRDSGIFKELKSGFSSGFSSDVVTKFSASPELNKYGLEHKNLVFDEGSRIEKCSSSSYLPISTGCEEAQNSFSRFHLEPSLVKHKNNQISEGSTRKEHENEGQCSEMSKKTRTLRCCANKSESDDCTRKIDLSSREGDSQPQHKAGPFSRRVSKTKRKHPPTHLNKHVKRLHSNCKVLNVDNERSDDEGIYVGESNSSDRKKQEDNMTTLDRTKCQQQGSRLLVRKLPKYVSLNCIVNETNSEDACSGSASIDSSLIATGITNDNRKSPKIVPLNLILKKAKRCHAIKPLSKTENIHFSEEKSSDGSADKSSSGDRSFSPQDELWSPKKNRYSSNVSRPHVKTDCQSPCCVLEEDEPLSLADMGTSQLSASRSRGSKNQRACISLNRMERCEEFTNESACSPCGDKHAAVQACVTKFERYIQRPSLDASCCVCGISNLEPSNQLIECSKCFIKVHQACYGVLKVPRGQWFCKPCKINTQDTVCVLCGYGGGAMTRALKAQNILKSLLRGIATAKRSDKYVYSSGNVNSECTSKLHGEYVRHDSFNGHRSRSFNAISSFGIKEASIGSARGDIISKSWTSNRNSSLLGPRTRQWVHVVCGLWTPGTKCPNTITMSAFDISGASPAKRNTECSMCNRTGGSFMGCRDVNCSVLFHPWCAHQRGLLQSEPEGEHNENVGFYGRCLDHAMLDPNHVNPKKECLRSNDWTCARTEVFRGRKGDSFGANRSRKPEEKFGECSVSQEQINAWIRINGSKSCMRGQKEYVHYKQLKGWKHLVVYKSSIHGLGLYTSEFIPRGSMVVQYVGEIVGQCVADKREIEYQSGKRQQYKSACYFFKIGKEHIIDATRKGGIARFINHSCQPNCVAKIISVRNEKKVVFFAERHINPGEEITYDYHFNREDEGQRIPCFCRSRGCRRYLN

SEQ ID NO: 7410 - protein, 1105 aa, Setaria italica
MSSGGRGGKRRAPPPPAPSGAAAKRAHPNPGTPQPPPPAAAAAPGAEEEDMMDEDVFLDESILAEDEAALLMIQRDEALASRLARWKRPALPADLATGCSRTVAFQQLEIDYVIGENHKELLPNSSGPAAILRIFGVTREGHSICCQVHGFEPYFYIGCPSGMGPDDISRFHQTLEGRMKESNRSSNVPRFVKRVELVQKQTIMHYQTQQSQPFLKIVVALPTMVASCRGILERGITIEGLGSKSFLTYESNILFALRFMIDCNIVGGNWIEVPAGKYRKAARVMSYCQLELDCLYSDLVSHAAEGEYSKMAPFRILSFDIECAGRKGHFPEPTHDPVIQIANLVTHQGEGQPFVRNVMTLKSCSPIVGVDVMSFDTERDILLAWRDLIREVDPDIIIGYNICKFDLPYLIERAEVLKITEFPLLGRIRNSRVRVRDTTFSSRQYGVRESKDVTIEGRVQFDLLQAMQRDYKLSSYSLNSVSAHFLGEQKEDVHHSIISDLQNGNSETRRRLAVYCLKDAYLPQRLLDKLMYIYNYVEMARVTGVPISFLLSRGQSIKVLSQLLRKAKQKNLVIPNIKGQGSGQDTFEGATVLEARAGFYEKPIATLDFASLYPSIMMAYNLCYCTLVPPEDARKLNLPPESLNKTPSGEIFVKPELQKGILPEILEELLAARKRAKADLKEAKDPLERAVLDGRQLALKISANSVYGFTGATVGQLPCLEISSSVTSYGRQMIEHTKKLVEDKFTTVGGYEHNAEVIYGDTDSVMVQFGASTVEDAMKLGREAADYISGTFTKPIKLEFEKVYFPYLLISKKRYAGLYWTNPEKFDKMDAKGIETVRRDNCLLVKNLVTECLHKILVDRDIPGAVQYVKNTISDLLMNRVDLSLLVITKGLTKTGEDYAVKAAHVELAERMRKRDPATAPTVGDRVPYVIIKAAKGAKAYEKSEDPIYVLDNNIPIDPQYYLENQISKPLLRIFEPILKNASKELLHGSHTRSVSISTPSNSGIMKFAKKQLTCLGCKAVISGASQTLCSHCKGREAELYCKTVANVSDLEVLFGRLWTQCQECQGSLHQDVLCTSRDCPIFYRRRKAQKDMAEARLQLDRWDF

SEQ ID NO: 7411 - protein, 1106 aa, Brachypodium distachyon
MSSGGRGGKRRTAPPQAPSAAAAKRAHPMPTTGTPQPPPPAPPAATAEEEDMMDEDVFLDEAILAEDEAALLLLDRDEALASRLSRWKRPALPADLVSGCSRSVAFQQLDIDYVIGESHRELLPNTSGPAAIIRIFGVTKEGHSVCCQVHGFEPYFYISCPSGMGPDDISRFQQALEVRMKESNRSSNVPRFVKRVDLVQKQTIMHYQTQKSQSFLKIVVALPTMVASCRGILERGITIEGFGSKSFLTYESNILFALRFMIDCNIVGGNWIEVPRGKYRKAARIMSYCQLELDCIYSDLVSHAAEGEYSKMAPFRILSFDIECAGRKGHFPEPTHDPVIQIANLLTLQGEAQPFVRNVMTLKSCSPIVGVDVMSFDTERDILLAWRDLIREADPDIIIGYNICKFDLPYLIERAEVLKIVEFPLLGRIRNSRVRVRDTTFNSRQYGVRESKDVTVEGRVQFDLLQAVQRDYKLSSYSLNSVSAHFLGEQKEDVHHSIISDLQNGNSETRRRLAVYCLKDAYLPQRLLDKLMYIYNYVEMARVTGVPISFLLSRGQSIKVLSQLLRKAKQRNLVIPNIKGQGSGQDTFEGATVLEARAGFYEKPIATLDFASLYPSIMMAHNLCYCTLVPPEDVRKLNLPPESLYKTPSGEIFVKPELQKGILPEILEELLTARKRAKADLKEAKDPFERAVLDGRQLALKISANSVYGFTGATVGQLPCLEISSSVTSYGRQMIEHTKKLVEDKFTTLGGYEHNAEVIYGDTDSVMVQFGVSTVEDAMKLGREAADYISGTFIKPIKLEFEKVYFPYLLISKKRYAGLYWTNPEKFDKMDTKGIETVRRDNCLLVKNLVTECLHKILVDRDVPGAVQYVKNTISDLLMNRVDLSLLVITKGLTKTGEDYAVKAAHVELAERMRKRDAATAPTVGDRVPYVIIKAAKGAKAYEKSEDPIYVLDNNIPIDPQYYLENQISKPLLRIFEPILKNASRELLHGSHTRAVSISTPSNSGIMKFAKKQLTCLGCKAVISGPNQTLCSHCKGREAELYCKTVANVSDLEMLFGKLWTQCQECQGSLHQDVLCTSRDCPIFYRRRKAQKDMAEARVQLDRWDF

SEQ ID NO: 7412 - protein, 1099 aa, Sorghum bicolor
MSSGGRGGKRRGPPPPAPSGAAAKRANPSPGMPQPPPPAAAEEDMMDEDVFLDESILAEDEAALLMLQRDEALASRLARWKRPALPSDLAAGCSRAVAFQQLEIDYVIGESHKELLPNSSGSAAILRIFGVTREGHSICCQVHGFEPYFYIGCPSGMGPDDISRFHQTLEGRMKESNRSSNVPRFVKRVELVQKQTIMHYQTQESQPFLKIVVALPTMVASCRGILERGIMIEGLGSKSFLTYESNILFALRFMIDCNIVGGNWIELPAGKYRKAARLMSYCQLELDCLYSDLVSHAAEGEYSKMAPFRILSFDIECAGRKGHFPEPTHDPVIQIANLVTHQGEGQPFVQNVMTLKSCSPIVGVDVRSFDTERDILLAWRDFIREVDPDIIIGYNICKFDMPYLIERAEVLKIAEFPILGRIRNSRVRVRDTTFSSRQYGVRESKDVTIEGRVQFDLLQAMQRDYKLSSYSLNSVSAHFLGEQKEDVHHSIISDLQNGNSETRRRLAVYCLKDAYLPQRLLDKLMYIYNYVEMARVTGVPISFLLSRGQSIKVLSQLLRKAKQKNLVIPNIKGQGSGQDTFEGATVLEARAGFYEKPIATLDFASLYPSIMMAYNLCYCTLVPPEDARKLNLPPESINKTPSGEIFVKPELQKGILPEILEELLAARKRAKADLKEAKDPLERAVLDGRQLALKISANSVYGFTGATVGQLPCLEISSSVTSYGRQMIEHTKKLVEDKFTTVGGYEHNAEVIYGDTDSVMVQFGVSTVQDAMKLGREAADYISGTFTKPIKLEFEKVYFPYLLISKKRYAGLYWTNPEKFDKMDAKGIETVRRDNCLLVKNLVTECLHKILVDRDVPGAVQYVKNTISDLLMNRVDLSLLVITKGLTKTGEDYAVKAAHVELAERMRKRDPATAPTVGDRVPYVIIKAAKGAKAYEKSEDPIYVLDNNIPIDPQYYLENQISKPLLRIFEPILKNASKELLHGSHTRSVSISTPSNSGIMKFAKKQLTCLGCKAVISGASQTLCSHCKGREAELYCKTVANVSDLEMLFGRLWTQCQECQGSLHQDVLCTSRDCPIFYRRRKAQKDMAEARLQLDRWDF

SEQ ID NO: 7413 - protein, 1101 aa, Sorghum bicolor
MSSGGRGGKRRGPPPPAPSGAAVKRANPSPGMPQPPPPAAAAAEEDMMDEDVFLDESILAEDEAALLMLQRDEALASRLARWKRPALPADLAAGCSRTVAFQQLEIDYVIDESHKELLPNSSGSAAILRIFGVTREGHSICCQVHGFEPYFYIGCPSGMGPDDISHFHQTLEGRMKESNRSSNVPRFVKRVELVQKQTIMHYQTQQSQPFLKIVVALPTMVASCRGILERGIMIEGLGSKSFLTYESNILFALRFMIDCNIVGGNWIELPAGKYRKAARVMSYCQLELDCLYSDLVSHAAEGEYSKMAPFRILSFDIECAGRKGHFPEPTHDPVIQIANLVTHQGEGQPFVQNVMTLKSCSPIVGVDVMSFDAERDILLAWRNFIREVDPDIIIGYNICKFDMPYLIERAEVLKIAEFPILGRIRNSRVRVRDTTFSSRQYGVRESKDVTIEGRVQFDLLQAMQRDYKLSSYSLNSVSAHFLGEQKEDVHHSIISDLQNGNPETRRRLAVYCLKDAYLPQRLLDKLLYIYNYVEMARVTGVPISFLLSRGQSIKVLSQLLRKAKQKNLVIPNIKGQGSGQDTFEGATVLEARAGFYEKPIATLDFASLYPSIMMAYNLCYCTLVPPEDARKLNLPPESINKTPSGEIFVKPELQKGILPEILEELLAARKRAKADLKEAKDPLERAVLDGRQLALKISANSVYGFTGATVGQLPCLEISSSVTSYGRQMIEHTKKLVEDKFTTVGGYEHNAEVIYGDTDSVMVQFGVSTVEDAMKLGREAADYISGTFTKPIKLEFEKVYFPYLLISKKRYAGLYWTNPEKFDKMDAKGIETVRRDNCLLVKNLVTECLHKILVDRDVPGAVQYVKNTISDLLMNRVDLSLLVITKGLTKTGEDYAVKAAHVELAERMRKRDPATAPTVGDRVPYVIIKAAKGAKAYEKSEDPIYVLDNNIPIDPQYYLENQISKPLLRIFEPILKNASKELLHGSHTRSVSISTPSNSGIMKFAKKQLTCLGCKAVISGASQTLCSHCKGREAELYCKTVANVSDLEMLFGRLWTQCQECQGSLHQDVLCTSRDCPIFYRRRKAQKDMAEARLQLDRWDF

SEQ ID NO: 7414 - protein, 1103 aa, Secale cereale
MSSVGRGGKRRAGPPAAPSPLAAKRAQPMPPGAPQPPPPAAAAAEEEDMMDEDVFLDETILAEDEAALLLLDRDEALASRLSRWKRPALPADLVSGCSRSVAFQQLDIDYVIGESHKEFLPNSSGPAAIIRIFGVTREGHSVCCQVHGFEPYFYISCPPGMSPDDISGFKQTLEARMKESNRNSSVQRFVKSVELLQKQTIMHYQPIKSQSFLKIVVALPTMVASCRGILERGITIGSLGSKSFLTYESNILFALRFMIDCNIVGGNWIELPAGKYSKATRVMSYCQLELDCLYSDLVSHAPEGEYSKMAPFRILSFDIECAGRKGHFPEPTHDPVIQIANLLTLQGESQPFVRNVMTLKSCSPIVGVDVMSFDTERDILLAWRDLIREADPDIIIGYNICKFDLPYLIERAEVLKIVEFPLLGRIRNSRVRVRDTTFNSRQYGMRESKDVTVEGRVQFDLLQAMQRDYKLSSYSLNSVSAHFLGEQKEDVHHSIISDLQNGNSETRRRLAVYCLKDAYLPQRLLDKLMYIYNYVEMARVTGVPISFLLSRGQSIKVLSQLLRKAKQRNLVIPNIKGQSSGQDTFEGATVLEARAGFYEKPIATLDFASLYPSIMMAHNLCYCTLVPPEDVRKLNLPAESLYKTPSGEIFVKPELQKGILPEILEELLAARKRAKADLKEAKDPFERAVLDGRQLALKISANSVYGFTGATVGQLPCLEISSSVTSYGRQMIEHTKKLVEDKFTTLGGYEHNAEVIYGDTDSVMVQFGVSTVEDAMKLGREAAEYISGTFIKPIKLEFEKVYFPYLLISKKRYAGLYWTNPEKFDKMDTKGIETVRRDNCLLVKNLVTECLHKILVDRDVPGAVQYVKNTISDLLMNRVDLSLLVITKGLTKTGEDYAVKAAHVELAERMRKRDAATAPTVGDRVPYVIIKAAKGAKAYEKSEDPIYVLDNNIPIDPQYYLENQISKPLLRIFEPILKNASRELLHGSHTRAVSISTPSNSGIMKFAKKQLTCLGCKAVISGPNQTLCSHCKGREAELYCKTVANVSDLEMLFGKLWTQCQECQGSLHQDVLCTSRDCPIFYRRRKAQKDMAEARVQLDRWDF

SEQ ID NO: 7415 - protein, 1097 aa, Gossypium raimondii
MNKGGNPRKRPPPPSSHQPSPASKHQATTPTPPPPSTEEDFVDEDVFFDETLMGEEDVESLILRDFEERQALASRLSKWARPPLSDAYISQSRSIVFQQLEIDYVIGESHKGLLPDSSGQAAIIRIFGVTGEGHSVCCLVHGFEPYFYISCPPGMGPDDISHFHQTLEGRMKEMNRNSKVPKFVRRIELVQKRSIMYYQQQKSQPFLKIVVALPTMVATCRGILDRGIQIDGLGMKSFITYESNVLFALRFMIDCNIVGGNWIEIPAGKYKKTAKNMSYCQLEFDCLYSDLISHAPEGEFSKMAPFRILSFDIECAGRKGHFPEPSHDPVIQVANLVTLQGEDQPFIRNVMTLKSCSPIVGVDVMSFDTEKEVLLAWREFIREVDPDIIIGYNICKFDLPYLIERAQTLGIAEFPILGRIRNSRVRVKDTTFSSRQYGTRESKEVTVEGRVQFDLLQAMQRDYKLSSYSLNSVSAHFLSEQKEDVHHSIISDLQNGNAETRRRLAVYCLKDAYLPQRLLDKLMYVYNYVEMARVTGVPISFLLSRGQSIKVLSQLLRKSKQKNLVIPNVKQAGSEQGTFEGATVLEAKAGFYEKPIATLDFASLYPSIMMAYNLCYCTLVTPEDVRKLNLPPECVNRTPSGETFVKPELQKGILPEILEELLAARKRAKADLKEAKDPLEKAVLDGRQLALKVSANSVYGFTGATVGQLPCLEISSSVTSYGRQMIEHTKKLVEDKFTVLGGYEHNAEVIYGDTDSVMVQFGVSDVEAAMNLGREAAEHISGTFTKPIKLEFEKVYYPYLLISKKRYAGLFWTNPQKFDKMDTKGIETVRRDNCLLVKNLVTECLHKILIDRDIPGAVQYVKNTISDLLMNRMDLSLLVITKGLTKTGDDYEVKAAHVELAERMRKRDPATAPNVGDRVPYVIIKAAKGAKAYERSEDPIYVLENNIPIDPQYYLENQISKPLLRIFEPILKNASKELLHGSHTRSISISTPSNSGIMKFAKKQLSCIGCKALICNSDRTLCSHCKGREAELYYKTVSQVSELEELFGRLWTQCQECQGSLHQDVLCTSRDCPIFYRRKKAQKDMVEAKRQLDRWNF

SEQ ID NO: 7416 - protein, 1104 aa, Eucalyptus grandis
MSASTRKRPPPAAHPSPAAHPPKHQATAPPPPQQPAPRPPLEEEFLDEDVYLDETLIPGDDDHDEEYLILRDIEERQGLASRLSKWARPPLSDGYLSQSKNVVYQQLEIDYVIGESHRELLPDRSGPAAIIRIFGVTREGHSVCCNVHGFEPYFYISCPPGMGPDDISRFHQVLEGRMRDANRNSKVPKYVRRIEMVQKRSIMYYQQQTSHPFLKIVVALPTMVTTCRGILDRGIQIDGLGMKSFMTYESNILFALRFMIDRNVVGGNWIEVPAGKYRRTAKKLSYCQLEFDCLYSELISHSLEGEFSKMAPFRILSFDIECAGRKGHFPEPNHDPVIQVANLVTLQGESQPFVRNVMTLKSCSPIVGVDVMSFDTEREVLLAWRDLIREVDPDIIIGYNICKFDLPYLIERAEALGIPEFPILGRVRNSRVRVRDTTFSSRQHGTRESKEVTIEGRVQFDLFQAVQRDYKLSSYSLNSVSAHFLSEQKEDVHHSIISDLQNGNAETRRRLAVYCLKDAYLPQRLLDKLMFIYNYVEMARVTGVPISFLLSRGQSIKVLSQLLRKAKQKNLVIPNMKQAGSEQGTYEGATVLEAKAGFYEKPIATLDFASLYPSIMMAYNLCYCTLVTPEDVRKLNLPPECVNRTPSGETFVKSSLQKGILPEILEELLAARKRAKADLKEAKDPLERAVLDGRQLALKISANSVYGFTGATIGQLPCLEISSSVTSYGRQMIEHTKKLVEDKFTVLGGYEHNAEIIYGDTDSVMVQFGVPTVEEAMKLGREAADYISGTFIKPIKLEFEKVYYPYLLISKKRYAGLYWTSPEKFDKMDTKGIETVRRDNCLLVKNLVTECLHKILIDRDIPKAVQYVKSTISDLLMNRVDLSLLVITKGLTKSGDDYDVKAAHVELAERMRKRDAATAPTVGDRVPYVIIKAAKGAKAYEKSEDPIYVLENNIPIDPQYYLENQISKPLLRIFEPILKNASKELLQGSHTRSISISTPSNSGIMKFAKKQLTCIGCKALISNTNGTLCSHCKGREAELYCKSVSQVSELEEIFGKLWTQCQECQGSLHQDVLCTSRDCPIFYRRKKAQKDMAEAKRQLDRWNF

SEQ ID NO: 7417 - protein, 1085 aa, Cajanus cajan
MKKNGSRKRAPPPSQPPPAKHPSMTQEEEFMDEDVFLDETLLSADEESLILRDIEQRQALATRLSKWTRPPLDADYVVQSRSVVFQQLEIDYVIGESHKELLPNSSGPAAVIRIFGVTKEGHSVCCNVHGFEPYFYVCCPPGMGPDDISRFHQTLEGRMREANRNSNVGKFVRRIEMVQRRSIMYYQQSNSQPFLKIVVALPTMVASCRGILDRGIQLDGLGMKSFLTYESNVLFALRFMIDCNIVGGNWIEVPAGKYNKTARSLSYCQLEFDCLYSELISHPPEGEYSKMAPFRILSFDIECAGRKGHFPEPTHDPVIQIANLVTLQGEDQPLIRNVMTLKSCSPIVGVDVMSFDTEREVLLAWRDFIREVDPDIIIGYNICKFDLPYLIERAANLKIAEFPILGRIRNSRVRVKDTTFSSRQYGTRESKEVTVEGRVQFDLLQVMQRDYKLSSYSLNSVSAHFLSEQKEDVHHSIISDLQNGNAETRRRLAVYCLKDAYLPQRLLDKLMFIYNYVEMARVTGVPISFLLSRGQSIKVLSQLLRKARQKNLVLPNVKQAGSEQGTFEGATVLEARAGFYEKPIATLDFASLYPSIMMAYNLCYCTLVTPEDARKLNIPPESVNRTPSGETFVKSNLQKGILPEILEELLTARKRAKADLKEAKDPLEKAVLDGRQLALKISANSVYGFTGATIGQLPCLEISSSVTSYGRQMIEHTKKLVEDKFTTLNGYEHNAEVIYGDTDSVMVQFGVSAVEEAMNLGREAAEYISGTFTKPIKLEFEKVYYPYLLISKKRYAGLFWTKPDNFDKMDTKGIETVRRDNCLLVKNLVNDCLHKILIDRDIPGAVQYVKTAISDLLMNRMDLSLLVITKGLTKTGDDYEVKAAHVELAERMRKRDAATAPNVGDRVPYVIVKAAKGAKAYERSEDPIYVLENNIPIDPQYYLENQISKPILRIFEPILKNASKELLHGSHTRSISISTPSNSGILKFAKKQLTCIGCKALLSNGHHTLCSHCKGREAELYCKTVAQVSDLEMLFGRLWTQCQECQGSLHQDVLCTSRDCPIFYRRKKAQKDMAEARSQLDRWNF

SEQ ID NO: 7418 - protein, 1086 aa, Citrullus lanatus
MNNGSARKSRPPPQHPSPAPPTKHQALSQEEDFVDEDVFLDENLLDEDALILRDMEERQALASRLSKWARPPLSQEYLSQSKSIVFQQLEIDYVIGESHRELLPNLSGPAAILRIFGVTREGHSVCCHVHGFEPYFYISCPPGMGPDDISLFHRTLEARMKEVNRNSKAPNFVRRIELVQKRSIMYYQQQTSQPFLKIVVALPTMVTSCRGILDRGVQIDGFGMKSFMTYESNVLFALRFMIDCNVVGGNWIEVPVGKYKKTVRNLSYCQLEFDCLYSDLISHAPEGEFSKMAPFRILSFDIECAGRKGHFPEPTQDPVIQVANLVTLQGENQPFIRNVMTLNSCSPIAGVDVLSFDTEREVLLAWRDLIREADPDIIIGYNICKFDLPYLIERAEALKIPEFPILGRIRNSKVRVKDTTFSSRQLGTRESKEITVEGRVQFDLLQAMQRDYKLSSYSLNSVSSHFLSEQKEDVHHSIISDLQNGNAETRRRLAVYCLKDAYLPQRLLDKLMFIYNYVEMARVTGVPISFLLSRGQSIKVLSQLLRKAKQKNLVIPNAKHAGSDQGTYEGATVLEARAGFYEKPIATLDFASLYPSIMMAYNLCYCTLVTPEDARKLNLPPEHFNKTPSGEIFVKPELQKGILPEILEELLTARKRAKADLKEAKDPFEKAVLDGRQLALKISANSVYGFTGATVGQLPCIEISSSVTSYGRQMIEHTKKLVEDKFTTLGGYEHNAEVIYGDTDSVMVQFGVPSVEAAMILGREAADYISGTFIKPIKLEFEKVYYPYLLISKKRYAGLFWTNPNKFDKMDTKGIETVRRDNCLLVKNLVNECLHKILIDRDVPGAVQYVKNTISDLLMNRVDLSLLVITKGLTKTGDDYEVKAAHVELAERMRKRDAATAPNVGDRVPYVIIKAAKGAKAYERSEDPIYVLENSIPIDPQYYLENQISKPLLRIFEPILKNASKELLHGSHTRSIFISTPSNGGIMKFAKKQLTCIGCKALLSKADKTLCSHCKGREAELYCKAVANVSDLEMVFGRLWTQCQECQGSLHQDVLCTSRDCPIFYRRKKAQKDMAEAKQHLERWSF

SEQ ID NO: 7419 - protein, 1086 aa, Glycine max
MSNNASRKRAPPPPSQPPPAKQALMTQEEEFMDEDVFINETLVSEDEESLILRDIEQRQALANRLSKWTRPPLSAGYVAQSRSVLFQQLEIDYVIAESHRELLPNSSGPVAIIRIFGVTKEGHSVCCNVHGFEPYFYICCPPGMGPDDISHFHQTLEGRMREANRNSNVGKFVRRIEMVQRRSIMYYQQSNSQPFLKIVVALPTMVASCRGILDRGIQLDGLGMKSFLTYESNVLFALRFMIDCNIVGGNWIEIPAGKYKKTAKSLSYCQLEFDCLYSELISHAPEGEYSKMAPFRILSFDIECAGRKGHFPEPTHDPVIQIANLVTLQGEDQPFIRNVMTLKSCSPIVGVDVMPFETEREVLLAWRDFIREVDPDIIIGYNICKFDLPYLIERALNLKIAEFPILGRIRNSRVRVKDTTFSSRQYGTRESKEVAVEGRVQFDLLQVMQRDYKLSSYSLNSVSSHFLSEQKEDVHHSIISDLQNGNAETRRRLAVYCLKDAYLPQRLLDKLMFIYNYVEMARVTGVPISFLLSRGQSIKVLSQLLRKARQKNLVIPNAKQAGSEQGTFEGATVLEARAGFYEKPIATLDFASLYPSIMMAYNLCYCTLVIPEDARKLNIPPESVNRTPSGETFVKSNLQKGILPEILEELLTARKRAKADLKEAKDPLEKAVLDGRQLALKISANSVYGFTGATIGQLPCLEISSSVTSYGRQMIEHTKKIVEDKFTTVNGYEHNAEVIYGDTDSVMVQFGVSAVEEAMNLGREAAEYISGTFTKPIKLEFEKVYYPYLLISKKRYAGLFWTKPDNFDKMDTKGIETVRRDNCLLVKNLVNDCLHKILIDRDIPGAVQYVKNAISDLLMNRMDLSLLVITKGLTKTGDDYEVKAAHVELAERMRKRDAATAPNVGDRVPYVIIKAAKGAKAYEKSEDPIYVLENNIPIDPQYYLENQISKPIMRIFEPILKNASKELLHGSHTRSISISTPANSGILKFAKKQLTCIGCKALLGNGHHTLCSHCKGREAELYCKTVSQVSELEMLFGRLWTQCQECQGSLHQDVLCTSRDCPIFYRRKKAQKDMAEAKLQLDRWNF

SEQ ID NO: 7420 - protein, 1091 aa, Citrus clementina
MNRSNGSARKRPPPTPKESWPNKQQATTPTTPVIDDEFLDEDVFLDETLLPEDEESLILRDIEQRQDFASRLAKWARPPLSSGYVSQCQSIMFQQLDIDYVIGDSNRELLPLSSGSAAIIRIFGVTREGHSVCCKVHGFEPYFYISCPQGMGPDDISHFHQILEGRMREANRNSKVPQFVRHIEMVQKRSIMYYQQQKSQPFLKIVVALPTMVASCRGILDRGIQLDGLGMKSFMTYESNVLFALRFMIDCNIVGGNWIEVPVGKYRKTAKTLSYCQLEFDCLYSDIISHHPEGEFSKMAPFRILSFDIECAGRKGHFPEPTHDPVIQVANLVTLQGEKQPFIRNVMTLKSCAPIVGVDVMSFETERDVLLAWRDFIREVDPDVMIGYNICKFDLPYLIERSQTLGIAEFPILGRIRNSRVRVKDTTFSSRQLGTRESKEVTVEGRVQFDLLQVMQRDYKLSSYSLNSVSAHFLSEQKEDVHHSIISDLQNGNAETRRRLAVYCLKDAYLPQRLLDKLMFIFNYVEMARVTGVPISFLLSRGQSIKVLSQLLRKAKQKNLVIPNVKQAGSEQGTYEGATVLEARAGFYEKPIATLDFASLYPSIMMAYNLCYSTLVTPEDARKLNLPPECVNKTPSGETFVKSNLQKGILPEILEELLAARKRAKADLKEAKDPLEKAVLDGRQLALKISANSVYGFTGATVGQLPCIEISSSVTSYGRQMIEHTKKLVEDKFTTVGGYEHNAEVIYGDTDSVMVQFGVPTVEAAMKLGREAADYISGTFIKPIKLEFEKVYYPYLLISKKRYAGLYWTNPEKFDKMDTKGIETVRRDNCLLVKNLVTECLHKLLVDRDIPGAVQYVKSTISDLLMNRMDLSLLVITKGLTKTGDDYEVKAAHVELAERMRKRDAATAPNVGDRVPYVIIKAAKGAKAYERSEDPIYVLENNIPIDTHYYLENQISKPLLRIFEPILKNASKELLSGDHTRSISISTPSNSGIMKFAKRQLSCIGCKALISNGTLCSHCKGREAELYCKTVSQVQELEVLFGRLWTQCQECQGSLHQDVLCTSRDCPIFYRRKKAQKDMAEAKLQLDRWNF

SEQ ID NO: 7421 - protein, 1085 aa, Glycine max
MSNNASRKRAAPPSQPPPAKQAVMTQEEEFMDEDVFLNETLVSEDEESLILRDIEQRQALANRLSKWTRPPLSADYVAGTRSVLYQQLEIDYVIGESHRELLPNSSGPAAIIRIFGVTKEGHSVCCNVHGFEPYFYICCPPGMGPDDISHFHQTLEGRMREANRNSNVGKFIRRIEMVQRRSIMYYQQSNSQPFLKVVVALPTMVASCRGILDRGIQLDGLGMKSFLTYESNVLFALRFMIDCNIVGGNWIEIPAGKYKKTVKSLSYCQLEFDCLYSELVSHAPEGEYSKMAPFRILSFDIECAGRKGHFPEPTQDPVIQIANLVTLQGEDQPFIRNVMTLKSCSPIVGVDVMSFETEREVLLAWRDLIREVDPDIIIGYNICKFDLPYLIERAANLKIAEFPILGRIRNSRVRVKDTTFSSRQYGTRESKEVTVEGRVQFDLLQVMQRDYKLSSYSLNSVSSHFLSEQKEDVHHSIISDLQNGNAETRRRLAVYCLKDAYLPQRLLDKLMFIYNYVEMARVTGVPISFLLSRGQSIKVLSQLLRKARQRNLVIPNAKQAGSEQGTFEGATVLEARAGFYEKPIATLDFASLYPSIMMAYNLCYCTLVTPEDARKLNIPPESVNRTPSGETFVKSNLQKGILPEILEELLTARKRAKADLKEAKDPLEKAVLDGRQLALKISANSVYGFTGATIGQLPCLEISSSVTSYGRQMIEHTKKLVEDKFTTLNGYEHNAEVIYGDTDSVMVQFGVSAVEEAMNLGREAAEHISGTFTKPIKLEFEKVYYPYLLISKKRYAGLFWTKPDNFDKMDTKGIETVRRDNCLLVKNLVNDCLHKILIDRDIPGAVQYVKNAISDLLMNRMDLSLLVITKGLTKTGDDYEVKAAHVELAERMRKRDAATAPNVGDRVPYVIIKAAKGAKAYERSEDPIYVLENNIPIDPHYYLENQISKPILRIFEPILKNASKELLHGSHTRSISISTPSNSGILRFAKKQLTCIGCKALLGKGYHTLCSHCKGREAELYCKTVSQVSELEMLFGRLWTQCQECQGSLHQDVLCTSRDCPIFYRRKKAQKDMGEAKLQLDRWNF

SEQ ID NO: 7422 - protein, 1086 aa, Prunus persica
MNKGISRKRPAPTQQPSPANPPKQHATSQEDEFLDEDVFLDETLFETEDDLILRDIEERQSLASRLTKWARPSISHAYSSASRSIAFQQLEIDYVVGDSNRELLPNWSGSAAIIRIFGVTKEGHSVCCHVHGFEPYFYISCPPGMGPDDISRFHQILEGRMGEMNRNSKVPKFIRHIEMVQKRSIMYYQQQDSHPFLKIVVALPTMVASCRGILDRGIQIDGLGMKSFMTYESNVLFALRFMIDCNIVGGNWIEVPAGRYKTAKHSSYCQLEFDCLFSDLISHAPEGEFSKMAPFRILSFDIECAGRKGHFPEPTHDPVIQIANLVTLQGENQPFIRNVMTLKSCSPIVGVDVMSFDTEREVLLAWRDLIREVDPDVIIGYNICKFDLPYLIERAETLGIAEFPMLGRIKNSRVRVKDTTFSSRQYGTRESKEVTVEGRVQFDLFQAMQRDYKLSSYSLNSVSAHFLSEQKEDVHHSIISDLQNGNAETRRRLAVYCLKDAYLPQRLLDKLMYIYNYVEMARVTGVPISFLLSRGQSIKVLSQLLRKAKQKNLLIPNVKQAGSEQGTYEGATVLEAKAGFYEKPIATLDFASLYPSIMMAYNLCYCTLVTTEDARKLNIPPEFVNKTPSGETFVKSNLQKGILPEILEELLAARKRAKADLKEAKDPLEKAVLDGRQLALKISANSVYGFTGATVGQLPCIEISSSVTSYGRQMIEHTKNLVKEKFTILKGYEHNAEVIYGDTDSVMVQFGVSTVEAAMNLGREAAEYISGTFIKPIKLEFEKVYYPYLLISKKRYAGLLWTSPDKFDKMDTKGIETVRRDNCLLVKNLVNECLHKILIDRDIPGAVQYVKNTISDLLMNRMDLSLLVITKGLTKTGDDYEVKAAHVELAERMRKRDAATAPNVGDRVPYVIIKAAKGAKAYEKSEDPIYVLENNIPIDPQYYLENQISKPLLRIFEPILKNASKELLHGSHTRSISISTPSNSGIMKFAKKQLTCVGCKALISNADRTLCSHCKGREAELYCKTVAHVSELETLFGRLWTQCQECQGSLHQDVLCTSRDCPIFYRRKKAQKDMAEAKVQLDRWSF

SEQ ID NO: 7423 - protein, 489 aa, Cicer arietinum
MMAYNLCYCTLVTPENARKLNIPPESVNRTPSGETFVKPNLQKGILPEILEELLAARKRAKADLKEAKDPLEKAVLDGRQLALKISANSVYGFTGATIGQLPCLEISSSVTSYGRQMIEHTKKLVEDKFTTLNGYQHTAEVIYGDTDSVMVQFGVSAVEEAMSLGREAAEYISGTFTKPIKLEFEKIYYPYLLISKKRYAGLFWTKPDNFDKMDTKGIETVRRDNCLLVKNLVNDCLHKILIDRDIPGAVQYVKNAISDLLMNRMDLSLLVITKGLTKTGDDYEVKTAHVELAERMRKRDAATAPNVGDRVPYVIIKAAKGAKAYEKSEDPIYVLENNIPIDPQYYLENQISKPILRIFEPILKNASKELLHGSHTRSISISTPSNSGIMRFAQKQYTCIGCKALLSKGDRTLCAHCKGREAELYCKTVAQVSDLEILFGRLWTQCQECQGSLHQDVLCTSRDCPIFYRRKKAQKDMAEARLQLDRWNF

SEQ ID NO: 7424 - protein, 1094 aa, Theobroma cacao
MNNGGNSRKRPPPPSQRQPFPATKHQVTSPAPPPLPTEEDFVDEDVFLEETLMGEEDVESLILRDVEERQALASRLSKWARPPLSGAYTSQSCSIVFQQLEIDYVIGESNKDLLPDSSGPAAIIRIFGVTREGHSVCCLVHGFEPYFYISCPPGMGPDDISRFQQTLEGRMKELNRNSKVPKFVRRVELVQKRSIMYYQRQKSQPFLKIVVALPTMVTSCRGILDRGIQIDGLGMKSFMTYESNVLFALRFMIDCNIVGGNWIEIPAGKYKKTAKNLTYCQLEFDCLYSELISHAPEGDFSKMAPFRILSFDIECAGRKGHFPEPTHDPVIQVANLVTLQGKDQPFIRNVMTLKSCSPIVGVDVMSFDTEKEVLLAWREFIREVDPDIIIGYNICKFDLPYLIERAQTLGIAEFPILGRIRNSRVRVKDTTFSSRQYGTRESKEVTVEGRVQFDLLQVMQRDYKLSSYSLNSVSAHFLSEQKEDVHHSIISDLQNGNAETRRRLAVYCLKDAYLPQRLLDKLMFIYNYVEMARVTGVPLSFLLSRGQSIKVLSQLLRKSKQKNLVIPNVLEAKAGFYEKPIATLDFASLYPSIMMAYNLCYCTLVTPEDVRKFNLPPECVNKTPSGETFVKPNLQKGILPEILEELLGARKRAKADLKEAKDPLEKAVLDGRQLALKISANSVYGFTGATVGQLPCLEISSSVTSYGRQMIEHTKKLVEDKFTVLGGYEHNAEVIYGDTDSVMVQFGVPDVEAAMNLGREAAEYISGTFTKPIKLEFEKVYYPYLLISKKRYAGLFWTNPQKFDKMDTKGIETVRRDNCLLVKNLVNECLHKLLIDRDIPGAVQYVKNTISDLLMNRMDLSLLVITKGLTKTGDDYEVKAAHVELAERMRKRDAATAPNVGDRVPYVIIKAAKGAKAYERSEDPIYVLENNIPIDPQYYLENQISKPLLRIFEPILKNASKELLHGSHTRSISISTPSNSGIMRFAKKQLSCIGCKALIRYLTLHHIEFSLSNTDRTLCSHCKGREAELYYKTVSQVSELEELFGRLWTQCQECQGSLHQDVLCTSRDCPIFYRRKKAQKDMVEAKRQLDRWNF

SEQ ID NO: 7425 - protein, 768 aa, Cucumis sativus
MNNGNARKSRPPPHHPSPAPPPKHQALSQEEDFVDEDVFLDESLLDEDALILRDIEERQALASRISKWARPPLSQDYLSQSKSIVFQQLEIDYVIGESHKELLPNLSGPAAILRIFGVTREGHSVCCHVHGFEPYFYISCPSGMGPDDISLFHRTLEARMKEVNRNNKAPNFVRRIELVQRRSIMYYQQQTFQSFLKIVVALPTMVTSCRGILDRGIQIEGFGMKSFMTYESNVLFALRFMIDCNVVGGNWIEVPVGKYKKTVRSLSYCQLEFDCLYSDLISHAPEGEFSKMAPFRILSFDIECAGRKGHFPEPTQDPVIQVANLVTLQGEDQPFVRNVMTLNTCSPIAGVDVLSFDTERDVLLAWRDLIREVDPDIIIGYNICKFDLPYLIERAEALKIPEFPLLGRIRNSKVRVKDTTFSSRQLGTRESKEITVEGRVQFDLLQVMQRDYKLSSYSLNSVSSHFLSEQKEDVHHSIISDLQNGNAETRRRLAVYCLKDAYLPQRLLDKLMFIYNYVEMARVTGVPISFLLSRGQSIKVLSQLLRKAKQKNLVIPNAKHAGSDQGTYEGATVLEARAGFYEKPIATLDFASLYPSIMMAYNLCYCTLVTPEDACKLNLPPEHFNKTPSGEIFVKPNLQKGILPEILEELLTARKRAKADLKEAKDPFEKAVLDGRQLALKISANSVYGFTGATVGQLPCLEISSSVTSYGRQMIEHTKKLVEDKFTTLGGYKHNAEIIDNLILLLHQSIFHRLSYRIQYFMVLGNLW

SEQ ID NO: 7426 - protein, 1086 aa, Solanum lycopersicum
MNSGNSKKRSAAATPSPQQQQKHHAAMEEEDLDEDVFLEETLLQYEEDSQVLRELEESNSIKERLQKWKRPSLSQAYIAQTQSISFQQLEIDYIIAESHKELLPNSSGQAAILRIFGVTKEGNSVCCHVHGFEPYFYISCPPGMGPDDISRFHQILEGRMREANRNSNAPKFVRRIEVVQKRSIMYYQQQASQPFLKIVVALPTMVTSCRGILDRGIQIDGLGMKSFLTYESNVLFALRFMIDCNIVGGNWIEVPVGKYKKAARNLSYCQLEFDCLYSDLISHSPEGEFSKMAPFRILSFDIECAGRKGHFPEPTQDPVIQVANLVTLQGQDQPLIRNVMTLKSCSPIVGVDIMSFDTEKEVLRAWRDLIREVDPDIIIGYNICNFDLPYLIRRAEVLGMAEFPVLGRIRNSRVRVKDATFSSRQHGTRESKEITIEGRVQFDLFQAVQRDYKLSSYSLNSVSAHFLNEQKEDVHHSIISDLQNGNAETRRRLAVYCLKDAYLPQRLLDKLMFIYNYVEMARVTGVPISFLLSRGQSIKVLSQLLRKAKQKDLVIPNAKQVGSEQGTFEGATVLEAQAGFYEKPIATLDFASLYPSIMMAYNLCYCTLVTPEEVRKLNLPPECVNKTPSGETFVKSTLQKGILPEILEELLTARKRAKADLKEATDPRVKAVLDGRQLALKISANSVYGFTGATVGQLPCLEISSSVTSYGRQMIEHTKKLVEDKFTVLGGYEHNAEVIYGDTDSVMVQFGVPTVEEAMKLGREAADYISGTFIKPIKLEFEKIYYPYLLISKKRYAGLLWTNPDKHDKMDAKGIETVRRDNCLLVKNLVTECLYKILVDRDVPGAVQYVKNTISDLLLNRMDLSLLVITKGLTKTGDDYEVKAAHVELAERMRKRDAATAPSIGDRVPYVIIKAAKGAKAYEKSEDPIYVLENNIPIDPQYYLENQISKPLLRIFEPILKNASKELLHGDHTRSISVPTPSNSGIMRFAKKQLTCIGCKTPLSGSDRTICKHCKGREAELYCRSVANVAELENLFGKLWTQCQECQGSLHQDVLCTSRDCPIFYRRKKAQKDMAEAKTQLDRWNF

SEQ ID NO: 7427 - protein, 1088 aa, Populus trichocarpa
MNRNGSTRKRPPPTPQPPNPSPAVKHQAITPTVDEEFLDEDVFLDETLIAEDEENLNKERQVLTSRLSKWARPKLSDGYVSQSQSIIFQQLEIDYVIGETHKELLPDRSGSAAILRIFGVTGEGHSVCCLVHGFEPYFYVSCPPGMNPDDISHFHKILEGKMREVNRNTKVPKFVRRIELVHKRSIMYYQQQQSHPFLKIVVALPTMVSGCRGILDKGIQIDGLGMRSFMTYESNVLFALRFMIDCNVVGGNWIEVPAGKYKKTSKSLSNCQLEFDCLYSELISHAAEGEFSKMAPFRILSFDIECAGRKGHFPEPTHDPVIQVANLVTLQGEDQPFVRNIMTLNSCSPIVGVDVMSFDTEREVLIAWKEFIREVDPDIIIGYNICKFDLPYLIERAATLGISEFPVLGRIRNSRVRIKDATFSSRQYGTRESKEVTVEGRVQFDLLQVMQRDYKLSSYSLNSVSAHFLSEQKEDVHHSIISDLQNGNAETRRRLAVYCLKDAYLPQRLLDKLMLIYNYVEMARVTGVPLSFLLARGQSIKVLSQLLRKAKEKNLVIPNVKQAGSEQGKYEGATVLEPKAGFYEKPIATLDFASLYPSIMMAYNLCYCTLVTPEDVRKLNLPPECINKTPSGETFVKSNLQKGILPEILEELLTARKRAKADLKEAKDPFEKAVLDGRQLALKISANSVYGFTGATVAQLPCLEISSSVTSYGRQMIEHTKKLVEDKFTILGGYEHNAEVIYGDTDSVMVQFGVPTVEAAMKLGREAAECISGTFIKPIKLEFEKVYYPYLLISKKRYAGLFWTNPDKFDKMDTKGIETVRRDNCLLVKNLVTECLHKILIDRDVPGAVQFVKNTISDLLMNRMDLSLLVITKGLTKTGDDYEVKAAHVELAERMRKRDAATAPNVGDRVPYVIIKGAKGAKAFEKSEDPIYVLENNIPIDPQYYLENQISKPLLRIFEPILKNASKELLQGSHTRSISISTPSTGGIMKFAKKQLTCIGCKTLLSNSDRTLCSNCKGREAELYCKSVSQVSELEQLFGRLWTQCQECQGSLHQDVLCTSRDCPIFYRRKKAQKDMAGAKTQLDRWSF

SEQ ID NO: 7428 - protein, 1096 aa, Aquilegia formosa
MNNKKRTPPPSSTPTQQQPPKRFQQTMDEDEMIDEDVFLEETLLREEEEAMILHDAEQRKQALASRLTIWKRPSLSPSYVSQTSNIIFQQLEIDYVIGERNKELLPNSSGPAAILRIFGVTKEGHSVCCNVHGFEPYLYMSCPPGMGPDDVSRFHRSLEVRIKEDYRVKNIKAPQFVLRIEMVHKRSIMYYQQQQSHLFLKIVVVLPKMVAICRDILEKGIQIDGFGTKCFLTYESNVLFALRFMIDCNIVGGNWIEVCSGKYKKATKPMSYCQLEFDCLYSELTSHAPEGEFSKMAPFRILSFDIECAGRKGLFPEPTHDPVIQVANLVTLQGEDHPFVRNIMTLKSCSPIVGVDVMSFDTEREVLLAWRDFFHEVDPDIIIGYNICKFDLPYLIERAEVLKVAEFPILGRIRNSRVRVNAKTFSSRQYGTRESKEITIEGRVQFDLLQSMQRDYKLSSYSLNSVSAHFLGEQKEDVHHSIISDLQNGNSETRRRLAVYCLKDAYLPQRLLDKLMFVYNYVEMARVTGVPISFLLSRGQSIKVLSQLLRKAKQKNLVLPCVSKQGSGDSTFEGATVLEARTGFYEKPIATLDFASLYPSIMMAYNLCYCTLVTPEDVRKLNLPPECVNKTPSGETFVKSELQKGILPEILEELLAARKRAKADLKEAKDPLEKAVLDGRQLALKISANSVYGFTGATVGQLPCLEISSSVTSYGRQMIEHTKKLVEERFTTLGGYEHNAEANPFHQVVYGDTDSVMVQFGVPTVDAAMTLGREAAEYISGTFIRPIKLEFEKVYYPYLLINKKRYAGLYWTSPDKFDKMDTKGIETVRRDNCLLVKNLITECLHKILIDRDIPGAVQYVKNTISDLLMNRMDLSLLVITKGLTKTADDYNAKAAHVELAERMRKRDAATAPNVGDRVPYVIIKAAKGAKAYERSEDPIYVLENNIPIDAQYYLENQISKPLLRIFEPILKNASKELLHGSHTRAVSISTPSNSGIMKFAKKQLCCLGCKALISNSEHTLCAHCKGREAELYCKTVANVADLEILFGRLWTQCQECQGSLHQDVLCTSRDCPIFYRRKKAQKDMAEARVQLDRWQF

SEQ ID NO: 7429 - protein, 1052 aa, Phaseolus coccineus
MDEDVFMEQTLISEDEESMILRDIEQRQALAARLSKWARPPLSADYVKQVVFQQLEIDYVIGESHRELLPNLSGPAAIIRIFGVTKEGHSVCCNVHGFEPYFYICCPPGMGPDDISHFHQTLEGRMREANRNSNVGKFVRRIEMVQRRSIKYYQQSDSQSFLKIVVALPTMVASCRGILDRGIQLDGLGMKSFWTYESNVLFALRFMIDCNIVGGNWIEIPAGKYKKIAKSLSYCQLEFDCLYSDLISHAPEGEYSKMAPFRILSFDIECAGRKGHFPEPSHDPVIQIANLVTLQGEDQPLIRNVMTLKSCSPIVGVDVMSFDTEREVLLAWRDLILEVDPDIIIGYNICKFDLPYLIERAANLKIAEFPILGRIRNSRVRVKDTTFSSRQYGTRESKEVAVEGRVQFDLLQVMQRDYKLSSYSLNSVSAHFLSEQKEDVHHSIISELQNGTPETRRRLAVYCLKDAYLPQRLLDKLMLIYNYVEMARVTGVPISFLLSRGQSIKVLSQLLRKARQKNLVIPSVKQVGSEQGTFEGATVLEARAGFYEKPIATLDFASLYPSIMMAYNLCYCTLVTSEDARKLNIPPESVNRTPSGETFVKANLQKGILPEILEELLTARKRAKADLKEARDPLERAVLDGRQLALKISANSVYGFTGATIGQLPCLEISSSVTSYGRQMIEHTKKLVGDKFTTLNGYEHNVEVIYGDTDSVMVQFGVSSVEQAMNLGREAAEYISGTFTKPIKLEFEKVYYPYLLISKKRYAGLFWTKPDNFDKMDTKGIETVRRDNCLLVKNLVNDCLHKILIDRDIPGAVQYVKNAISDLLMNRMDLSLLVITKGLTKTGDDYEVKAAHVELAERMRKRDAATAPNVGDRVPYVIIKAAKGAKAYEKSEDPIYVLENNIPIDPQYYLENQISKPILRIFEPILKNASRELLHGDHTRSISISTPSNIGLLKYAKRNLTCIGCKAVLGKDLHTVCSHCKGREAELYCKTVSQVSELEKLFGRLWTQCQECQGSLHQDVLCTSRDCPIFYRRKKAQKDMSEAKSQLDRWSF

SEQ ID NO: 7430 - protein, 1097 aa, Eutrema parvulum
MNRGGNSKKRPPPSNNLPAGKHRATGNPTPSPAAGTLEDEFVDEDVFMDEEALLVGQEDDESLILRDMEEREAVSARSSTWARPPLSSAYLSNSQSIIFQQLEIDYVIRESHKELLPASSGQAAVIRIFGVTREGHSVCCYVHGFEPYFYIACPPGMGPDDISRFHQSLEGRMRESNKNANVPKFVRHIEMVQKRSIMYYQQQKSQSFLKITVALPTMVASCRGILDRGIQIDGLGMKSFQTYESNIVFALRFMVDRDVVGGNWIEVPTGKYKKDARTLSYCQLEFSCLYSDLISHAAEGEYSKMAPFRVLSFDIECAGRKGHFPEAKHDPVIQIANLVTLQGEDQPFVRNVMTLKSCAPIVGVDVMSFETEREVLLAWRDFIRDVDPDIIIGYNICKFDLPYLIERAATLGIEEFPLLGRVKNSRVRVRDSTFSSRQQGTRESKETTIEGRFQFDLFQAILRDYKLSSYSLNSVSAHFLSEQKEDVHHSIITDLQNGNAETRRRLAVYCLKDAYLPQRLLDKLMYIYNYVEMARVTGVPISFLLARGQSIKVLSQLLRKAKQKNLVLPNAKQSGSEQGTYEGATVLEARTGFYEKPIATLDFASLYPSIMMAYNLCYCTLVTPEDVCKLNLPPEHINKTPSGETFVKQSLQKGILPEILEELITARKRAKADLKEAKDPLEKAVLDGRQLALKISANSVYGFTGATIGQLPCLEISSSVTSYGRQMIEQTKKFVEDKFTTLGGYEYNAEVIYGDTDSVMVQFGVSDVEAAMTLGREAAEYISGTFIKPIKLEFEKVYFPYLLINKKRYAGLLWTNPQKFDKMDTKGIETVRRDNCLLVKNLVTESLHKILIDRDVPGAAEYVKNTISDLLMNRIDLSLLVITKGLTKSGDDYEVKSAHGELAERMRKRDAATAPNVGDRVPYVIIKAAKGAKAYERSEDPIYVLENNIPIDPNYYLENQISKPLLRIFEPVLKNASKELLHGSHTRSISITTPSNSGIMKFAKKQLSCVGCKVPISNGTLCTRCKGREAELYCKNVSQVSDLEEVFGRLWTQCQECQGSLHQDVLCTSRDCPIFYRRMKAQKDMAVAKQQLDRWSF

SEQ ID NO: 7431 - protein, 1095 aa, Arabidopsis thaliana
MNRSGISKKRPPPSNTPPPAGKHRATGDSTPSPAIGTLDDEFMMEEDVFLDETLLYGDEDEESLILRDIEERESRSSAWARPPLSPAYLSNSQSIIFQQLEIDSIIAESHKELLPGSSGQAPIIRMFGVTREGNSVCCFVHGFEPYFYIACPPGMGPDDISNFHQSLEGRMRESNKNAKVPKFVKRIEMVQKRSIMYYQQQKSQTFLKITVALPTMVASCRGILDRGLQIDGLGMKSFQTYESNILFVLRFMVDCDIVGGNWIEVPTGKYKKNARTLSYCQLEFHCLYSDLISHAAEGEYSKMAPFRVLSFDIECAGRKGHFPEAKHDPVIQIANLVTLQGEDHPFVRNVMTLKSCAPIVGVDVMSFETEREVLLAWRDLIRDVDPDIIIGYNICKFDLPYLIERAATLGIEEFPLLGRVKNSRVRVRDSTFSSRQQGIRESKETTIEGRFQFDLIQAIHRDHKLSSYSLNSVSAHFLSEQKEDVHHSIITDLQNGNAETRRRLAVYCLKDAYLPQRLLDKLMFIYNYVEMARVTGVPISFLLARGQSIKVLSQLLRKGKQKNLVLPNAKQSGSEQGTYEGATVLEARTGFYEKPIATLDFASLYPSIMMAYNLCYCTLVTPEDVRKLNLPPEHVTKTPSGETFVKQTLQKGILPEILEELLTARKRAKADLKEAKDPLEKAVLDGRQLALKISANSVYGFTGATVGQLPCLEISSSVTSYGRQMIEQTKKLVEDKFTTLGGYQYNAEVIYGDTDSVMVQFGVSDVEAAMTLGREAAEHISGTFIKPIKLEFEKVYFPYLLINKKRYAGLLWTNPQQFDKMDTKGIETVRRDNCLLVKNLVTESLNKILIDRDVPGAAENVKKTISDLLMNRIDLSLLVITKGLTKTGDDYEVKSAHGELAERMRKRDAATAPNVGDRVPYVIIKAAKGAKAYERSEDPIYVLQNNIPIDPNYYLENQISKPLLRIFEPVLKNASKELLHGSHTRSISITTPSNSGIMKFAKKQLSCVGCKVPISNGTLCASCKGREAELYCKNVSQVAELEEVFGRLWTQCQECQGSLHQDVLCTSRDCPIFYRRMKAQKDMAVARQQLDRWSF

SEQ ID NO: 7432 - protein, 747 aa, Pinus taeda
MTLKSCSPIVGVDVMSFDNEREVLLAWRDFIREVDPDLIIGYNICKFDLPYLIERAETLKITEFPFLGRIRNSRVRVRDTSFSSRQYGTRESKEATIEGRVQFDLFQVMQRDYKLSSYSLNSVSAHFLGEQKEDVHHSIISDLHNGNPETRRRLAVYCLKDAYLPQRLLDKLMFIYNYVEMARVTGVPLSFLLSRGQSIKVLSQILRKSRQKNLLVPNIKGQGSGQETFEGATVLEAKSGFYEKPIATLDFASLYPSIMMAYNLCYCSLVRSEDIAKFNLQPECVNKTPSGETFVKPTLQKGILPEILEELLAARKRAKADLKEAKDPFEKAVLDGRQLALKISANSVYGFTGATVGQLPCLEISSSVTSYGRQMIEHTKRLVEERFTIVGGYQYNAEVVYGDTDSVMIQFGVPNIEEAMTLGREASDYISGTFTKPIKLEFEKIYYPYLLISKKRYAGLLWTKPDAYDKMDTKGIETVRRDNCLLVKNLVTECLHKILIDRDIPGAVQYVKNTISDLLMNRMDLSLLVITKGLTKTGDDYAVKAAHVELAERMRKRDAATAPTVGDRVPYVIIKAAKGAKAYEKSEDPIYVLENNIPIDPQYYLENQLSKPLLRIFEPILKNASKELLHGSHTRAVSISTPSNSGIMKFAKKQLSCIGCKTPISKDDQTLCSHCKGREAELYQKTVANVRELEMLFGKLWTQCQRCQGSLHQDVLCTSRDCPIFYRRKKAQKDLTEAEVQLERWQF

SEQ ID NO: 7433 - protein, 1094 aa, Arabidopsis lyrata
MNRAGNSKKRPPPSNTPPAVKHRATGNSTPSPAIGTLDDEFMVDEDVFLDEALLYGDEDEESLILRDIEERESRSSAWARPPLSPAYLSNSQSIIFQQLEIDSIISESHKELLPGSSGQAPIIRMFGVTREGNSVCCFVHGFEPYFYIACPPGMGPDDISKFHQILEGRMRESNKNAKVPKFVRRIEMVQKRSIMYYQQQESQTFLKITVALPTMVASCRGILDRGLQIDGFGMKSFQTYESNIIFVLRFMVDCDIVGGNWIEVPTGKYKKNARTLSYCQLEFHCLYSDLISHAAEGEYSKMAPFRVLSFDIECAGRKGHFPEAKHDPVIQIANLVTLQGEDHPFVRNVMTLKSCAPIVGVDVMSFETEREVLLAWRDLIRDVDPDIIIGYNICKFDLPYLIERAATLGIEEFPLLGRVKNSRVRVRDSTFSSRQQGIRESKETTIEGRFQFDLIQAIHRDHKLSSYSLNSVSAHFLSEQKEDVHHSIITDLQNGNAETRRRLAVYCLKDAYLPQRLLDKLMFIYNYVEMARVTGVPISFLLARGQSIKVLSQLLRKAKQKNLVLPNAKQSGSEQGTYEGATVLEARTGFYEKPIATLDFASLYPSIMMAYNLCYCTLVTPEDVRKLNLPPEHVTRTPSGETFVKQSLQKGILPEILEELLTARKRAKADLKEAKDPLEKAVLDGRQLALKISANSVYGFTGATNGQLPCLEISSSVTSYGRQMIEQTKKLVEDKFTTLGGYEYNAEVIYGDTDSVMVQFGVSDVEAAMNLGREAAEHISGTFIKPIKLEFEKVYFPYLLINKKRYAGLLWTNPQQFDKMDTKGIETVRRDNCLLVKNLVTESLNKILIDRDVPGAAENVKKTISDLLMNRIDLSLLVITKGLTKTGDDYEVKSAHGELAERMRKRDAATAPNVGDRVPYVIIKAAKGAKAYERSEDPIYVLQNNIPIDPNYYLENQISKPLLRIFEPVLKNASKELLHGSHTRSISITTPSNSGIMKFAKKQLSCVGCKVPISNGTLCASCKGREAELYCKNVSQVAELEEVFGRLWTQCQECQGSLHQDVLCTSRDCPIFYRRMKAQKDMAVARQQLDRWSF

SEQ ID NO: 7434 - protein, 1057 aa, Mimulus guttatus
MSATGNPRKRAAPPPPKNPAATPSPQLKHQATMEEEELDEDVFFEETLLQYEEEDSQRRALSDRLAKWKRPALSPSYISQSQNIVFQQLEMDYVVGDSHKELLPSSSGLAAIIRIFGVTKEGHSVCCFVHGFEPYFYINCPSGMGPDDISRFHKILEGKMSESNRNTRVPKFIRRIELVQKRSIMHYQQQNSHPFLKIVVALPTMVASCRGILERGIQIEGLGMKSFMTYESNVLFALRFMIDCNIVGGNWIEVPRGKHKTIPRSLTNCQLEFDCLFSDLISHAPEGEFSKMAPFRILSFDIECAGRKGHFPEPSQDPVIQIANLVTLQGEGQPFVQNVMTLKSCSSIVGVDVMSFDTEKEVLLAWRDFIREVDPDIIIGYNICKFDLPYLIQRADVLGIAEFPILGRIRNSRVRIKDTTFSSRQYGTRESKEVTIEGRVQFDLLQVMQRDYKLSSYSLNSVSSHFLNEQDAYLPQRLLDKLMFIYNYVEMARVTGVPLSFLLSRGQSIKVLSQLLRKAKQKSLILPNVKHPGSEQGTYEGATVLEPRAGFYEKPIATLDFASLYPSIMMAYNLCYCTLVSPEDVHKLNLPPECVNKTPSGETFVKSNLQKGILPEILEELLAARKRAKADLKDAKDPLEKAVLDGRQLALKISANSVYGFTGATVGQLPCLEISSSVTSYGRQMIEHTKKLVEDKFTVVGGYEHNAEVIYGDTDSVMVQFGVSTVDEAMNLGREAADYISGTFINPMKLEFEKVYYPYLLISKKRYAGLYWTNPQKFDKMETKGIETVRRDNCLLVKNLVTECLNKILIDRDVPAAVQYVKNTISDLLMNRMDLSLLVITKGLTKTGEDYEVKAAHVELAERMRKRDAATAPNVGDRVPYVIIKAAKGAKAYEKSEDPIYVLENNIPIDPNYYLENQISKPLLRIFEPILKNASKELLQGSHTRSISISTPSTGGIMKFAKKQRTCLGCKALISNSDHTLCSHCKGREAELYCKSVSNVADLEELFGRLWTQCQECQGSLHQDVLCTSRDCPIFYRRKKAQKDMAEARVQLERWNF

SEQ ID NO: 7435 - protein, 214 aa, Saccharum officinarum
MLSSTTLRPLVPAAASPSPAHLTACSSPALGRRAPAAAVAVRAARNYDSIPKREPFSSSRSILDEFLRLDKPLVQRTKDQITDYCTTTEGDECCSCWDAYFELNKLEQELPKEEISRMVKDSQGDVKYLIESIHHRSDLRKKMAEKARNSVPSSSQGQTAKPRPFPVPDGIPKTQEELAEEEEALMPESPYTRLLRRMGRYPDWYTPRPDHETD

SEQ ID NO: 7436 - protein, 209 aa, Zea mays
MLSPTTLRPLVPAAAPAHLTACFLPASGRRAPAAAVRAVRNYDSIPKREPFTSNRSTLDEFLRLDKPLVQRTKDQITDYCMTVEGDECCSCWDAYFELNKLEQELPKDEIARMVKDSEGDVRYLIESIHHRSDLRKKIAEKSRNSVPSGSQGQTAKPRPFPVPDGIPKTQEELTEEEEALMPESPYTRLLRRMGRYPEWYTPRPDHETD

SEQ ID NO: 7437 - protein, 209 aa, Pennisetum glaucum
MMSSTTLRPLVPAAAASHLTTGAPRAAGRRSAAVAARAVRNYDSIPKREPFSSSRSILDEFLRQEKPLVQRTKDQITDYCTTTEGDECCSCWDAYFELNKLEQELPKDEIARMVKDSEGDVRYLIDSIHHRSNLRKKMAEKARDTVSSSSLGQTAKPRPFPVPDGLPKTQEELAEEEEALMPESSYTRLLRRMGRYPDWYTPRPDHETD

SEQ ID NO: 7438 - protein, 208 aa, Panicum virgatum
MMSSTTLRPLVPAAASHITTGASPAAGRRSAVASVRAGRNYDSIPKRETFSSSRSILDEFLRQEKPLVQRTKDQITDYCTTIEGDECCSCWDAYFELNKLEQELPKEEIARMVKDSEGDVKYLIDSIHHRSNLRKKMAEKARDTVSSSSQGQMAKPRPFPVPDGLPKTQEELAEEEEALMPESPYTRLLRRMGRYPDWYTPRPDHETD

SEQ ID NO: 7439 - protein, 196 aa, Setaria italica
MMPSTTLRPLVPAAASPAAALTVRAVRNYDSIPKRKPFSSSRSILDEFLRQEKPLVQRTKDQITDYCTTIEGDECCSCWDAYFELNKLEHELPKDEIARMVKDSEGDVRYLIDSIHHRSNLRKKMAEKTRATVSSSSLGQSAKPRPFPVPDGLPKTQEELAEEEEALMPESSYTRLLRRMGRYPDWYTPRPDHETD

SEQ ID NO: 7440 - protein, 216 aa, Oryza sativa
MLSSTALRPLAQPATATATATAFSASRTAAAAGRRGSAAGVVVRAVRNYDSIPKREPFSSSRSVLDEFLRQEKPLVQRTKDQITDYCTTLEGDECCSCWDAYFELNKLEQELPKEEIARMVKDSEGDPRYLINSIHHRSDLRKKMAEKSHNSLSSNSLGQAAKPRPFPVPDGLPKTQEELAEEQEALMPESSYTRLLRRMGRFPDWYTPRPDHETD

SEQ ID NO: 7441 - protein, 514 aa, Zea mays
MDATPTRLFLGALLFLVPAALLLLLRARGRRRLPPGPPSLPLLGSVVWLTNSPAEIEPLLRRLFERYGPVVALRVGARLSVFVADRRIAHEALVDRGATLADRPALASVKFLDESDNTITRASYGPVWRLLRRNLVAETLHPSRVKLFAPARAWVRRVLVEKLGEAGPDAAPPRVVETFQYAINCLLVLMCFGERLDEPAVRAIASAQREALIYRSKNMQVFAFLPAVTKHLFRARLDKARALRRRVKELFVPLINARREYKKRGEEPRRETTFEHSYVDTLLDIKLHEDGDRPLTDDEIILLCSEFLDAGTDTTSTGLQWIMAELVKNPAIQEKLYSEIKAATDDNKEGVSEEDVHSMPYLKAVILEGLRKHPPAHFVLPHKAAEEMEIGGYLIPKGTVVNFMVAEMGRDEQEWKNPMQFSPERFLPGGDGEGVDVTGTKAIRMMPFGVGRRICAGLGIAMLHLEYFVANMVREYEWKEVPGDEVDFAEKNEFTVVMKKPLRPRLVPRRSHLN

SEQ ID NO: 7442 - protein, 517 aa, Sorghum bicolor
MDATRLFLGALLLLLPAAFLLLLRARGRRRLPPGPPSLPLLGSVVWLTNSPAETEPLLRRLFERYGPVVALRIGARLSVFVADRRIAHEALVDRGAALADRPAFPEGRFLGEDDNIITRASYGPVWRLLRRNLVAETLHPSRVRLFAPARAWARRVLVHKLGEPGPDAAPPRVVDTFQYAMFFLLVLMCFGERLDEPAVHAIASALREPLIYRSKNMQVFSFLPAVTKHLFRARLDKALAMRRRIKELFLPLIDARREYKKRPGGEPPKGETTLEHSYVDTLLDMKIEEDGAQRPLTDDEIIRLCSEFLNAGTDTTSTGLQWIMAELVKNPAIQEKLYNEIMAATDEDKQEGVAEEDVHKMPYLKAVILEALRKHPPAHFVLPHKAAEDMEIGGYLIPKGTTVNFMVAEMSRDEQEWKNPMEFSPERFLPGGDGEGVDVTGTKAIRMMPFGVGRRICPGLGIAMLHLEYFVANMVREYEWKEVPGDEVDFAEKNEFTVVMKKPLRPRLVPRRSHLKS

SEQ ID NO: 7443 - protein, 518 aa, Panicum virgatum
MDAPQLLLGALLFLVPAALLLLGLHRAGGKRPRLPPGPPSLPLLGSVVWLTNSPAEIEPLLRRLFERHGPVVALRVGARLSVFVADRRLAHAALVERGATLADRPALASARLLGENDNTITRASYGPVWRLLRRNLVAETLHPSRVRLFAPARAWVRRVLADKLGEAAPGAPPPRVVETFQYAMFCLLVLMCFGERLDEPAVRAIAAAQRESLIYISRNMTVFAFFPPVTKHLFRERLDKARALRRRVKELFLPLINARREYRRRGGEPKTETTFEHSYVDTLLDIKLHEDGDRPLTDDEIVLLCSEFLNAGTDTTSTGLQWIMAELVKNPAIQDKLYHEIKAATDDDKEEVSEEDVHNMPYLKAVILEGLRKHPPGHFVLPHKAAEDMEIGGYLIPKGTTVNFMVAEMGRDEREWKNPMEFSPERFLPGGEGEGVDVTGTKGIRMMPFGVGRRICAGLGIAMLHLEYFVANMVREFEWQEVPGEEVDFAEKNEFTTVMKKPLRPRLVPRRTRSASAH

SEQ ID NO: 7444 - protein, 517 aa, Setaria italica
MDAPQHLLLGALLFLLPAALLLVCARGKRLRLPPGPPSLPLLGSVVWLTNSPAEIEPLLRRLFDRHGPVVALRVGARLSVFVADRRLAHAALVERSAALADRPRLASVRLLGENDNTITRASYGPVWRLLRRNLVAETLQPSRVRLFAPARAWVRRVLVDKLEEPGPDAAPPRVVETFQYAMFCLLVLMCFGERLDEPAVRAIAAAQRESLIYLSRNMTVFAFIPAVTKHLFRARLDKARALRRRIKELYLPLINARREYRKRGGEPKKETTFEHSYVDTLLDIKLHEDGDRPLTNDEIILLCSEFLNAGTDTTSTGLQWIMAELVKNPKIQEKLYDEIKAATNDDKEEVSEEDVHKMPYLKAVILEGLRKHPPGHFVLPHKAAEDMEIGGYLIPKGTTVNFMVAEMGRDEREWKNPMEFSPERFLPGGDGEGVDVTGTKGIRMMPFGAGRRICAGLGMAMLHLEYFVANMVREFEWEEVPGEEVDFAEKNEFTTVMMKPLRPRLVPRRTQKSMSTH

SEQ ID NO: 7445 - protein, 344 aa, Setaria italica
LLFLLPAALLVRTRGKRPRLPPGPPSLPLLGNVVWLTNTPAEIEPLLRRLFDRHGPVVALRVGARLSVFVADRRLAHAALVERSAALADRPGLASARLLGENDNTITRASYGPVWRLLRRNLVAETLQPSRVRLFAPARAWVRRVLVDKLEEPGPDAAPPRVVETFQYAMFCLLVLMCFGERLDEPAVRAIAAAQRESLIYLSRNMTVFAFIPAVTKHLFRARLDKARALRRRIKELYLPLINARREYRKRGGEPKKETTFEHSYVDTLLDIKLHEDGDRPLTNNEIILLCSEFLNAGTDTTSTGLQWIMAELVKNPKIQEKLYVPPMTTRKRSPRRTSTRCRT

SEQ ID NO: 7446 - protein, 512 aa, Setaria italica
APQLLLGALLFLLPAALLVRTRGKQRPRLPPGPPSLPLLGSVVWLTNTPSEIEPLLRRLFQRHGPVVALRMGVRLNVFVADRRLAHAALVEAGAALADRPALASAGFLGEGDATISRAGYGPVWRLLRRNLVAETLHPSRVRQFAPARAWVRRVLAEKLGEHSGGPDAPPPRVVETFQYAMFCLLVLMCFGERLDEPAVRDIAAAQREALIYRSRNMPVFAFLPAVTKHLFRARLDKARALRRRVDELFLPLIDARREYKNMKPGGQPRKETTFEHSYVDTLLDIKLHEDDGDRPLTDNEIILLCSEFLDAGTDTTSTGLQWIMAELVKNPAIQERLYNEIKAAADDDDKEEVSEEDVHKMPYLKAVVLEGLRKHPPAHFVLPHKAAEDMEIGGYLIPKGASVNFMVAEMSRDEREWRNPTEFSPERFLPGGDGEGVDVTGTKGIRMMPFGVGRRICAGIGVAMLHLEYFVANMVREFEWQEVPGHEVDFAEKNEFTVVMKKPLRPRLVPRR

SEQ ID NO: 7447 - protein, 523 aa, Setaria italica
MDAPQLLLGALLFLLPAALLVRTRGKQRPRLPPGPPSLPLLGSVVWLTNTPSEIEPLLRRLFQRHGPVVALRMGVRLNVFVADRRLAHAALVEAGAALADRPALASAGFLGEGDATISRAGYGPVWRLLRRNLVAETLHPSRVRQFAPARAWVRRVLAEKLGEHSGGPDAPPPRVVETFQYAMFCLLVLMCFGERLDEPAVRDIAAAQREALIYRSRNMPVFAFLPAVTKHLFRARLDKARALRRRVDELFLPLIDARREYKNMKPGGQPRKETTFEHSYVDTLLDIKLHEDDGDRPLTDNEIILLCSEFLDAGTDTTSTGLQWIMAELVKNPAIQERLYNEIKAAADDDDKEEVSEEDVHKMPYLKAVVLEGLRKHPPAHFVLPHKAAEDMEIGGYLIPKGASVNFMVAEMSRDEREWRNPTEFSPERFLPGGDGEGVDVTGTKGIRMMPFGVGRRICAGIGVAMLHLEYFVANMVREFEWQEVPGHEVDFAEKNEFTVVMKKPLRPRLVPRRAHSTRTSTH

SEQ ID NO: 7448 - protein, 954 aa, Zea mays
MVSGHIFHCRKNSWPAEEYVGRTALQLLDFDGGAPPEQAWRRRLNSHANILKEFSVTFMEAMRMMSLGLRLWSYVREEASHGRKAPIDPFTKERCKPSASQGVPLGGMGSGSISRGFRGEFKNWHIIPGLCESSPIFVSRDGGNKKYSSVLAPGHHEGLKKNSDSGISSWDWNLSGQHSTYHALFPRAWTVYDGEPDPDLKISCRQISPFIPHDYKDSSLPTSVFVYTLVNTGRDRAKVSLLMTWANSIGGFSHNSGGHYNEPFITAKDNPPVTFAVAACETQNVNVTVLPVFGLSGENHVSAKEMWNTMLQNGHFDRENFSAGPSMPSSPGQKLCAAVSASTWVEPHGRCTVVFALAWSSPKVKFQKGCTYNRRYTQFYGTSEKSAVNLVHDALTKYKLWEEEIEKWQNPILKDERLPEWYKFTLFNELYFLVAGGTVWTDGQPPAIDEKKSPGFNHQKSSKRGTKDTNQGSVKDRHVNLAVEQVPHGGYMANGDDHSVSKFAAVHGSEMQEQINGLKSEEPIPYLISKDGPEHVGKFLYLEGVEYIMWNTYDVHFYASFALLDLFPKIELSIQRDFANAVLYEDRRKVKFLADGTSGIRKVKGAVPHDLGTHDPWHEMNAYNIHDTSKWKDLNPKFVLQIYRDFAATGDMQFGRDVWPAVCAAMDYMDQFDRDGDGLIENDGFPDQTYDAWTVHGISAYCGCLWLAALQAAATMAHRLGDRHFAEKYKLKFIKAKAVYEAKLWNGSYFNYDSGTSSNSRSIQADQLAGQWYAASSGLPPLFDEHKIRTALQKIFEFNVMKVKGGRMGAVNGMTPKGKVDETCMQSREIWTGVTYAVAANMLLHGMEHQGFTTAEGIFTAGWSEEGYGYWFQTPEGWTTDGHYRSLVYMRPLAIWAIQYAVSPPKAILEAPKVNLMDRIHISPHMVRAISEISIRKVAPDNRCFPSSAFHCEC

SEQ ID NO: 7449 - protein, 975 aa, Setaria italica
MVSGHIFHCRKNSWPAEEYVGRTALQLLDFDGGAPPEQAWRRKLNSHANLLKEFSVTFMEAMRMMSLGLRLWSYVREEASHGRKAPIDPFTKERCRPSASQGLPLGGMGSGSISRGFRGEFKNWHIIPGLCESSPVMENQFSIFVSRDGGNKKYSSVLAPGHHEGLKKNSDSGISSWDWNLSGQHSTYHALFPRAWTVYDGEPDPDLKISCRQISPFIPHDYKDSSLPAAVFVYTLVNTGKDRAKVSLLMTWANSIGGFSHNSGGHYNEPFIAEDGVSGVLLHHKTAKDNPPVTFAVAACETQNVNVTVLPVFGLSGENHVSAKEMWNTMVQDGHFNRENFSAGSSMPSSPGQKLCAAVSASTWVEPHGRCTVVFALAWSSPKVKFQKGCTYNRRYTQFYGTSERSAVNLAHDALTKYKLWEEKIEKWQNPILKDERLPEWYKFTLFNELYFLVAGGTVWTDGQPPAIDDKANPGSNQQKSSKRGSKDTKTESVKDSHVNLTAEQVPDSGHMTNDDERSVSKFAAIHGSQMQEQTNGGLKSEEPIPYLISKDGPENVGKFLYLEGVEYIMWNTYDVHFYASFALLDLFPKIELSIQRDFANAVLYEDRRKVKFLADGTSGIRKAKGAVPHDLGTHDPWHEMNAYNIHDTSKWKDLNPKFVLQIYRDFAATGDMQFGRDVWPAVCAAMDYMDQFDRDSDGLIENDGFPDQTYDAWTVHGISAYCGGLWLAALQAAATMAHRLGDRHYAEKYKLKFIKAKAVYEAKLWNGSYFNYDSGTSSNSKSIQADQLAGQWYTASSGLPPLFDEHKIRTALQKIFEFNVMKVKGGRMGAVNGMTPKGKVDETCMQSREIWTGVTYAVAANMLLHGMEHQGFTTAEGIFTAGWSEEGYGYWFQTPEGWTTDGHYRSLVYMRPLAIWAIQYALSPPKAILEAPKVNLMDRIHISPHMVRAISEISIRKIAPDNRCFPSSAFHCEC

SEQ ID NO: 7450 - protein, 972 aa, Panicum virgatum
MVSGHIFHYRRNSWPAEEYVGRTALQLLDFDGGAPPEQAWRRKLNCHANLLKEFSITFMEAMRMMTLGLRLWSYVREEASHGRKAPIDPFTKERCRPSASQGVPLGGMGSGSISRGFRGEFKNWHIIPGLCESAPVMENQFSIFVSRDGGNKKYSSVLAPGHHEGLKKKSDSGISSWDWNLSGQHSTYHALFPRAWTVYDGEPDPDLKISCRQISPFIPHDYKDSSLPTSVFVYTLVNTGKDRAKVSLLMTWANSIGGFSHNSGGHYNEPFIAEDGVSGVLLHHKTAKDNPPVTFVVAACETQNVNVTVLPVFGLTGENHVSAKEMWNTMVQNGNFNRENFSAGPSMPSSPGQKLCAAVSASTWVEPHGRCTVAFALAWSSPKVKFQKGCTYNRRYTQFYGTSERSAVNLVHDALTKYKLWEEEIEKWQNPILKDERLPEWYKFTLFNELYFLVAGGTVWTDGQPPAIDEKASPGSKSSKRGTKDTKVESVKDSHVNMTAEQVPDSGHMTNGDERSVSKFAAVHGSQMQEQTNGGLKSEEPIPYLISKDGPENVGKFLYLEGVEYIMWNTYDVHFYASFALLDLFPKIELSIQRDFANAVLYEDQRKVKFLADGASGIRKVKGAVPHDLGTHDPWHEMNAYNIHDTSKWKDLNPKFVLQIYRDFAATGDMQFGRDVWPAVCAAMDYMDQFDRDHDGLIENDGFPDQTYDAWTVHGISAYCGCLWLGALQAAATMAHRLGDRHFAEKYKLKFIKAKAVYEAKLWNGSYFNYDSGTSSNSRSIQADQLAGQWYTASSGLPPLFDEHKIRTALQKIFEFNVMKVKGGRMGAVNGMTPKGKVDETCMQSREIWTGVTYAVAANMLLHGMEHQGFTTAEGIFIAGWSEEGYGYWFQTPEGWTTDGHYRSLVYMRPLAIWAIQYALSPPKAILEAPKVNLMDRIHISPHMARAISEISIRKIAPDNRCFPSSAFQCEC

SEQ ID NO: 7451 - protein, 974 aa, Oryza sativa
MVSGNLFHCRRNSWPAEEYVGRTALQLLDFDGGSPPEQAWRRRLNSHANLLKEFSVTFMEAMRMMSLGLRLWSYVREEASHGRKAPIDPFTKEKCKPSASQGVPLGGMGSGSISRGFRGEFKNWHIIPGLCETSPVMENQFSIFVSRDGGNKKYSSVLSPGHHEGLKKCNDSGISSWDWNLSGQHSTYHALFPRAWTVYDGEPDPDLKISCRQISPFIPHDYKDSSLPTSVFVYTLVNTGKDRAKVSLLMTWANSIGGFSHHSGGHFNEPFIAEDGVSGVLLHHKTAKDNPPVTFAIAACETQNVNVTVLPVFGLSGEGHDSAKQMWDRMKQNGHFDRENFEAGTSMPSSSGETLCAAVSASTWVEPHGRCTVVFGLAWSSPKIKFQKGCTYNRRYTEFYGTSERSAVNLVHDALTKYRIWEEEIEKWQNPILKNEKLPEWYKFTLFNELYFLVAGGTVWTDGQPPVIDEKPSPGSNQQKSSKRGTRDTKQESVKDNHVKLTAEQVTNGGDLANGEEQSVSKYAAVHGPQMAKATNGLGSQEPIPYLLSKNGPENVGKFLYLEGVEYIMWCTYDVHFYASFALLDLFPKIELSIQRDFANAVLYEDRRRMKFLADGTSGIRKVKGAVPHDLGTHDPWHEMNAYNIHDTSKWKDLNPKFVLQVYRDFAATGDMSFGRDVWPAVCAVMDYMNQFDRDGDGLIENDGFPDQTYDAWTVHGISAYCGGLWLAALQAAATMAHRLGDRPFAEKYKLKFIQAKAVYEAKLWNGSYFNYDSGTSSNSRSIQADQLAGQWYAASSGLPPLFDENKIRSALQKIFEFNVMKVKGGRLGAVNGMTPNGKVDETCMQSREIWTGVTYGVAANMLLHGMEHQGFTTAEGIFIAGWSEEGYGYWFQTPEGWTIDGHYRSLIYMRPLAIWAMQWARSPPKAILDAPKVNLMDRIHLSPQMIRAMNEINVRKIAPDNRCFPSSAFRCEC

SEQ ID NO: 7452 - protein, 962 aa, Brachypodium distachyon
MVSGHLFHCRKNSWPPEEYVGRSALQLLDLDGAAPPEQAWRRRLNSHANILKEFSVTFMEAMKMMSLGVRLWSYVREEASHGRKAPIDPFTRESCKPSASQGVPLGGMGSGSISRGFRGEFKNWHIIPGLCENSPVMENQFSIFVSRDGGNKKCSSVLAPGHHDGLKKYSDSGISSWDWNLSGQHSTYHALFPRAWTVYDGEPDPDLKISCRQISPFIPHDYKESSLPTSVFVYTLVNTGRDRAKVSLLMTWANSIGGFSHHSGGHFNEPFIGEDGVSGVLLHHKTAKDNPPVTFAIAACETQNVNVTVLPVFGLSGENHVSAKDMWDIMKKDGHFNLENFNAGCSMPSSPGETLCAAVTASTWVEPHGRCTVAFALSWSSPKVKFQKGCTYNRRYTEFYGTSERSSINLVHDALTKYRLWEEEIEKWQNPILRDERLPEWYKFTLFNELYFLVAGGTVWTDGQPPAIDEKTNPASNQQKHSKKPIKDTKSESVKDNLPRPTAEQVFNGDDLTNGGPQMPEQTNGLRVQEPVPCIHSKDGPENVGKFLYLEGVEYIMWNTYDVHFYASFALLDLFPKIELSIQRDFADAVLYEDRRRVKFLADGTSGIRKVKGAVPHDLGTHDPWHEMNAYNIHDTSKWKDLNPKFVLQVYRDFAATGDMTFGRDVWPAVCAAMDYMDQFDRDGDGLIENDGFPDQTYDAWTVHGISAYCGCLWLAALQAAATMAHRLGDRPYAEKYKLKFIKAKAVYEAKLWNGSYFNYDSGTSSNSRSIQADQLAGQWYAASSGLPPIFDEHKIRSALQKIFEFNVMKVKGGRMGAVNGMTPKGKVDETCMQSREIWTGVTYGVAANMLLHGMEHQGFITAEGIFLAGWSEEGYGYWFQTPEGWTTDGHYRSLIYMRPLAIWAMQWALSPPKAILEAPKVNLMDRIHVSPQAARAISEISIRKIAPDNRCISSSTFQCEC

SEQ ID NO: 7453 - protein, 970 aa, Triticum aestivum
MVSGHLFHCRKNSWPPEEYVGRTALQLLDLDGGSPPEQAWRRRLNSHANILKEFSVTFMEAMKMMTLGMRLWSYVREEASHGRKAPIDPFTRERCKPSASQGVPLGGMGSGSISRGFRGEFKNWHIIPGLCENSPVMENQFSIFVSRDSGNKKYSSVLAPGHHEGLKKSSDSGISSWDWNLSGQHSTYHALFPRAWTIYDGEPDPDLKISCRQISPFIPHDYKDSSLPASVFVYTLVNTGRDRAKVSLLMTWANSIGGFSHHSGGHFNEPFIGDDGVSGVLLHHKTAKDNPPVTFSIAACETQNVSVTVLPVFGLSGENHASAKEMWDTMSKDGHFNRENFNAGCSMPSSSGETLCAAVSASTWVEPHGRCTVAFALAWSSPKVKFQKGCTYNRRYTEFYGTSERSSSIHLVHDALTKYRLWEEEIEKWQDPILKDEKLPEWYKFTLFNELYFLVAGGTVWTDGQPPAFSETSPAYQHKHSKKGTKSESVKDNHVKPAAEQVNDGDDLPNGEERSVSMYAAVHGSQMPEQTSGLRSQEPIPYLLSKDGPENVGKFLYLEGVEYIMWNTYDVHFYASFALLDLFPKIELSIQRDFADAVLYEDRRRVKFLADGTSGIRKVKGAVPHDLGTHDPWHEMNAYNIHDTSKWKDLNPKFVLQVYRDFAATGDMTFGRDVWPAVCAAMDYMDQFDRDCDGLIENDGFPDQTYDAWTVHGISAYCGGLWLAALQAAATMAHRLGDRPYAEKYKLKFMKAKAVYEAKLWNGSYFNYDSGTSSNSRSIQADQLAGQWYAASSGLPPIFDEHKIRSALQKIFEFNVMKVKGGRMGAVNGMTPKGKVDETCMQSREIWTGVTYGVAANMLLHGMEHQGFITAEGIFLAGWSEDGYGYWFQTPEGWTTDGHYRSLVYMRPLAIWAMQWALSPPKAILEAPKVNLMDRIHISPQAVRAVGEIGVRKIAPDNRCIPSSTFQCEC

SEQ ID NO: 7454 - protein, 974 aa, Elaeis guineensis
MVSGHLFLCRKHSWPAEEYVSRTTLQLLDFDGGAPPEQAWRRRPNSHANILKEFSVTFMEAIRMMRLGVRLWSYVREEASQGRKAPIDPFTRERCKPSASQGVPLGGMGSGSISRGFRGEFKHWQIIPGSCEASPVMTNQFSIFISRDGGNKKYSSVLAPGHHEGIKKFGDQGISSWDWNLSGQHSTYHALFPRAWTVYDGEPDPDLKISCRQISPFIPHNYHESSLPTSVFVYTLVNTGRERAKVSLLMTWANSIGGVSHHSGGHINEPFIGEDGVSGVLLHHKTAKDNPPVTFAIAACETQNVNVTVLPNFGLSGENCVTARDMWGTMVQDGQFDREYFNAGPSAPSAPGSTLCAAVSASTWVEPHGRCTVAFALAWSSPKVKFQKGCSYHRRYTKFYGTSERSAINLVHDALMGYKCWEEEIEKWQDPILKDEKLPEWYKFTLFNELYFLVAGGTVWTDGEAPVSNEKQNPGSNRQKSSKIAKEDANAVSTKRSHVNFAMEQISFDTGLHNGDEKMVPLSSAGDDSEDSDNLDSPESLQAGPLLHLHDGPENVGRFLYLEGVEYIMWCTYDVHFYASFALLDLFPKIELSIQRDFAQAVLYEDRRKVKFLADGNWGIRNVKGAVPHDLGTHDPWHEMNAYNIHDTSKWKDLNPKFVLQVYRDFAATGDTSFGRDVWPAVRAAIDYMEQFDRDDDGLIENDGFPDQTYDAWTVHGISAYCGCLWLAALQAAAAMAHRLGDHSFSEKCKIKFLKAKPVFEAKLWNGSYFNYDSGTSSNSRSIQADQLAGEWYTASSGLPSLFDDNKIRSTLQKIFEFNVMKVRGGRMGAVNGMHPNGKVDESCMQSREIWTGVTYSVAATMLLHGMEHQAFTTAEGIFIAGWSEEGYGYWFQTPEAWTTDGHYRSLMYMRPLAIWAMQWALSPPKAIIEAPKINMMDRMYISPLNVRAVHEMGVRKIAPKSSCFGDTVFHCEC

SEQ ID NO: 7455 - protein, 416 aa, Zea mays
MPDVQPLVSDFVLKLKRRKVEGSHAVARQTAELLRSVVSQHRMGSSANQAATLADAVRAVGEQLIAANPIELAVGNIVRRVLHIIKEEDISSTAVGIEGLSVTVDSDDEYDSEHDDRPALSAAVLAAHARNALRAPSLQTLLEDIPVSPAISRTASSTGDSDGKSKSAGDKSSTRKLKHDVIAAIGDLIDEIDSCYEPISEQAVELIHQNEVILTLGRSRTVKEFLYAAKEKKRSFRVFVAEGAPRYQGHVLAKELVEKGVQTTVITDSAVFAMISRVNMVIVGAHAIMANGGVIAPVGMNMVALAAQRHAVPFVVVAGSHKLCPLYPHNPEVLLNELKSPSDLLDFGEFSDCMNFSTQDGSPLLNVVNPTFDYVPPKLVSLFITDTGGHSPSYMYRLIAEYYSADDLVVRRKATS

SEQ ID NO: 7456 - protein, 414 aa, Oryza sativa
MPDVQPLVSEFVLKLKRRKVEGSHAVARQTAELLRSVVSQHRMGSTNQAAALADAVRGVGEQLIAANPIELAVGNIVRRVLHIIKEEDISSTAVGIEGLSVTAESDDEYDSGNDDHPTLSAAVLAAHARNALRAPSLQTLLEDIPVSTALSRSASSAGDSDGKSGDKSSKSRKLKHDVIAAIGDLIDEIDTCYDQISEQAVEHIHQNEVILTLGRSRTVKEFLYAAKEKKRSFRVFVAEGAPRYKGHVLAKELVEKGVQTTVITDSAVFAMISRVNMVIVGAHAIMANGGVIAPVGMNMVALAAQRHAVPFVVVAGSHKLCPLYPHNPEVLLNELKSPSDLLDFGEFSSCMNFSTQDGTPLLNVVNPTFDYVPPKLVSLFITDTGGHSPSYMYRLIAEYYSADDLVVRRKSTSS

SEQ ID NO: 7457 - protein, 414 aa, Brachypodium distachyon
MPDVQPLVSEFVLKLKRRKVEGSHAVARQTAELLRSVVSQHRMGSTNQAAALADAIRSVGEQLISANPIELAVGNIVRRVLHIIKEEDISSTAVGIEGLSVTVDSDDEYDSGNDDHPTLSAAVLASHARNALRAPSLQTLLDDIPVSTALSRSASSTGDSDGKTAGDKSLKTRKLKHDVIAAIGDLIEEIDTCYDQISEQAVELIHQNEVILTLGRSRTVKEFLYAAKEKKRSFRVFVAEGSPRYQGHVLAKELVEKGVQTTVITDSAIFAMISRVNMVIVGAHAIMANGGVIAPVGMNMVALAAQKHAVPFVVVAGSHKLCPLYPHNPEVLLNELKSPSDLLDFGEFSNCMNFSTQDGTPLLNVVNPTFDYVPPKLVSLFVTDTGGHSPSYMYRLISEYYSADDLVVQRKSTS

SEQ ID NO: 7458 - protein, 413 aa, Brachypodium distachyon
MPDVQPLVSEFVLKLKRRKVEGSHAVARQTAELLRSVVSQHRMGSTNQAAALADAIRSVGEQLISANPIELAVGNIVRRVLHIIKEEDISSTAVGIEGLSVTVDSDDEYDSGNDDHPTLSAAVLASHARNALRAPSLQTLLDDIPVSTALSRSASSTGDSDGKTGDKSLKTRKLKHDVIAAIGDLIEEIDTCYDQISEQAVELIHQNEVILTLGRSRTVKEFLYAAKEKKRSFRVFVAEGSPRYQGHVLAKELVEKGVQTTVITDSAIFAMISRVNMVIVGAHAIMANGGVIAPVGMNMVALAAQKHAVPFVVVAGSHKLCPLYPHNPEVLLNELKSPSDLLDFGEFSNCMNFSTQDGTPLLNVVNPTFDYVPPKLVSLFVTDTGGHSPSYMYRLISEYYSADDLVVQRKSTS

SEQ ID NO: 7459 - protein, 270 aa, Avena sativa
MPDVQPLVSDFVLKLKRRKVEGSHAVARQTAELLRSLVSQHRMGSTNQAAALADAIRAVGEHLIAANPIELAVGNIVRRVLHIIKEEDISSTAVGIEGLSVTAVSDDEYDSGNDDRPTLSAAVLASHARNTLRAPSLQTLLDDIPVSTALSHSASSAGDSDGKAGDKSLKTRKLKHDVIAAIGDLIEEIDTCYDQISEQAVELIHQNEVILTLGRSRTVKEFLYAAKKRSDLFVYLLLKVLQDTRDMFLRKNWLRKGYRLLLLLIQLFLL

SEQ ID NO: 7460 - protein, 413 aa, Secale cereale
MPDMQPLISDFVLKLKRRKVEGSHAVARQTAELLRSVVSQHRMGSNNQGAALADAIHAVGEHLIAANPIELAVGNTVRRVLHIIKEEDISSTAVGIEGLSVTAVSDDECDSGNDDRPTLSAAVLASHARNALRAPSLQTLLDDIPVSTALSHSSSSAGDSDGKTGDKSLKTRKLKHDVIAAIGDLIEEIDTCYDQISEQAVEHIHQNEVILTLGRSRTVKEFLYAAKEKKRSFRVFVAEGAPRYQGHVLAKELVEKGVQTTVITDSAVFAMISRVNMVIVGVHAIMANGGVIAPVGMNMVALAAQRHAVPFVVVAGSHKLCPLYPHNPEVLLNELKSPSDLLDFGEFSNCMNFSTQDGTPLLNVANPTFDYVPPKLVSLFITDTGGHSPSYMYRLISEYYSADDLVVRRKSTS

SEQ ID NO: 7461 - protein, 413 aa, Triticum aestivum
MPDMQPLISDFVLKLKRRKVEGSHAVARQTAELLRSVVSQHRMSSTNQAAALADAIHAVGEHLIAANPIELAVGNTVRRVLHIIKEEDISFTAVGIEGLSVTAVSDDECDSGNDDRPTLSAAVLASHARNALRAPSLQTLLDDIPVSTALTHSSSSAGDSDGKTGDKSLKTRKLKHDVIAAIGDLIEEIDTCYDQISEQAVEHIHQNEVILTLGRSRTVKEFLYAAKEKKRSFRVFVAEGAPRYQGHVLAKELVEKGVQTTVITDSAVFAMISRVNMVIVGVHAIMANGGVIAPVGMNMVALAAQRHAVPFVVVAGSHKLCPLYPHNPEVLLNELKSPSDLLDFGEFSNCMNFSTQDGTPLLNVANPTFDYVPPKLVSLFITDTGGHSPSYMYRLISEYYSADDLVVRRKSTS

SEQ ID NO: 7462 - protein, 413 aa, Hordeum vulgare
MPDMQPLISDFVLKLKRRKVEGSHAVARQTAELLRSVVSQHRMGSTNQAAALADAIHAVGEHLIAANPIELAVGNTVRRVLHIIKEEDISFTAVGIEGLSVTAVSDDECDSGNDDRPTLSAAVLASHARNALRAPSLQTLLDDIPVSTALSHSSSSAGDSDGKTGDKSLKTRKLKHDVIAAIGDLIEEIDTCYDQISEQAVEHIHQNEVILTLGRSRTVKEFLYAAKEKKRSFRVFVAEGAPRYQGHALAKELVEKGVQTTVITDSAVFAMISRVNMVIVGVHAIMANGGVIAPVGMNMVALAAQRHAVPFVVVAGSHKLCPLYPHNPEVLLNELKSPSDLLDFGEFSNCMNFSTQDGTPLLNVANPTFDYVPPKLVSLFITDTGGHSPSYMYRLISEYYSADDLVVRRKSTS

SEQ ID NO: 7463 - protein, 116 aa, Panicum virgatum
LADAVRAVGEQLIAANPIELAVGNIVRRVLHIIKEEDISATAVGIEGLSVTVDSDDEYDNERDDRPSLSAAVLAAHARNALRAPSLQTLLEDIPVSPAISRTASSTGDSDGKISWR

SEQ ID NO: 7464 - protein, 170 aa, Elaeis guineensis
MPDVQALVNDFVLKLKRRKIEGSHASAQHTAELLRSVISHQRMPYTNQAGALIDAVKAVGEQLIAANPVELAVGNIVRRVLHIIREEDLSSTATAIEGLGLSAGSDDDDEGQHEDRPALSAAALAAAARSTLRAPSLQTLLEDIPDSAAAPQPPSSGGDSEGKANQQIRT

SEQ ID NO: 7465 - protein, 348 aa, Setaria italica
DSVLAELAVGNIVRRVLHIIKEEDISSTAVGIEGLSVTVDSDDEFDSEHDDRPALSAAVLAAHARNALRAPSLQTLLEDIPVTPAISRTASSTGDSDGKTGDKSSTRKLKHDVIAAIGDLIDEIDSCYEPISEQAVELIHQNEVILTLGRSRTVKEFLYAAKEKKRSFRVFVAEGAPRYQGHVLAKELVEKGVQTTVIIDSAVFAMISRVNMVIVGAHAIMANGGVIAPVGMNMVALAAQRHAVPFVVVAGSHKLCPLYPHNPEVLLNELKSPSDLLDFGEFSDCMNFSTQDGSPLLNVVNPTFDYVPPKLVSLFVTDTGGHSPSYMYRLIAEYYSADDLVVQRKSTA

SEQ ID NO: 7466 - protein, 345 aa, Saccharum officinarum
MTPLECDMAPAASPKKHLSRSRPLPRHCCLMILVLALATTAAVASAQLSSEDYYDASCPAALLTIRIAVSTAVLLDRRMGASLLRLHFHDCFVQGCDASVLLDDTASFTGEKGAGPNAGSLRGFDVIDNIKTLLELLCPQTVSCADILAVAARDSVAQLGGPSWSVPLGRRDATTASASLANSDLPGPTSNLNGLLNAFSNKGLSSTDMVALSGAHTVGRAQCKNFRPRIYNDTDIDATYAASLRASCPAQAGGASDGALEPLDGSTPDAFDNAYFGNLLSQRGLLHSDQALFGGGGATDGLVSTYASSADQWGSDFAAAMVKMGNINPLTGTDGEIRVNCRRVN

SEQ ID NO: 7467 - protein, 330 aa, Setaria italica
MAPAASRTHHHRSLALVVLALVAAATATVAGAQLSSEDYYDASCPAALLTIRSAVAAAVLLDRRMGASLLRLHFHDCFVQGCDASVLLDDAGGFTGEKGAGPNAGSLRGFDVIDNAKMLLELLCPQTVSCADILAVAARDAVEQLGGPSWTVPLGRRDATTASASLANSDLPGPTSNLNGLLNAFSNKGLSTTDMVALSGAHTVGRAQCRNFRARIYNDTDIDATFAASLRASCPAQAGSSSDGALEPLDGTSPDAFDNDYFGNLLSQRGLLHSDQALFGGGATDGLVRAYASDAGRWGSDFAAAMVRMASIGPLTGTDGEIRVNCRRVN

SEQ ID NO: 7468 - protein, 543 aa, Zea mays
MSGHRNSHGKRYSDYTETGGGKRRNPGDDTYAPGPDDTVYRYLCASRKIGSIIGRGGEIAKQLRTETQAKIRIGESVPGCEERVITIFSSSRRTNTIDDAEDKVCPAQDALFRVHERLATDESFGNEDSEEISPQVTVRLLVPSDQIGCILGKGGHIIQGIRSETGAQIRVLSKDHIPACAISGDELLQISGDMVVVKKALCQVSSRLHNNPSKSQHLLASSLTQPYPGGTHLGGSSAAPVVGITPVIPPYGGYKGDVAGDWPSLYQPRRDESSAKEFSLRLLCAAANVGGVIGKGGGIIKQIRQESGALIKVASSNSDPDDDCIITVSAKEFFEDPVSPTIDAAVRLQLRCSEKSDSELAEQSYTTRLLVSTSRIGCLIGKGGSIITEIRRTSRANIRILSKENVPKVAAEDEEMVQISGGLDVARHALVQIATRLKANFFEREGSLSAFPSVIPYHPLPAGVSVSDEPKYLSRDTKPVGHYLYSSAFRTSDDMIPSDSYASYGGSQAPGGGYAAYSGYSARSSSSGLSGHSSLHYGKHHGY

SEQ ID NO: 7469 - protein, 541 aa, Zea mays
MAGHRNSHGKRQSDFTENGGSKRRNPGDDTYAPGPDDTVYRYLCASRKIGSIIGRGGEIAKQLRTETQAKIRIGESVPGCDERVVTIFSTSRKTNTIDGAEDEVCPAQDALFRVHERLASDEGLGNEDSEEISPQVTVRLLVPSDQIGCIIGKGGQIIQGIRSETGAQIRVLSNDHIPACAISGDELLQISGDTVVVRKALHQVSSRLHNNPSKSQHLLASSLTQPYPGSTHLGGSSTAPVVGITPVIPPYGGYKGDVAGDWPSLYQPRRDESSAKEFSLRLLCAAANVGGVIGKGGGIIKQIRQESGALIKVASSNSDPDDDCIITVSAKEFFEDPVSPTIDAAVRLQPRCSEKSDLESAEQSYTTRLLVSTSRIGCLIGKGGSIITEIRRTSRANVRILSKENVPKVAAEDDEMVQITGGLDVARNALVQIATRLKANFFEREGSLSAFPPVIPYHPLPAGVSDEPKYLGRDTKPVGHYLYSSGFRTSDDTIPSDSYASYGGSQAPGRGYGAYSGYSARSSNSGLSGHSSLHYGKRHGY

SEQ ID NO: 7470 - protein, 541 aa, Setaria italica
MAGHRNSHGKRHSDYAENGGGKRRNPGDDSYAPGPDDTVYRYLCASRKIGSIIGRGGEIAKQLRAETQAKIRIGESVPGCEERVITIFSSSRETNTIDDAEDKVCPAQDALFRVHERLASDEGPGNEDSEEVLPQVTVRLLVPSDQIGCIIGKGGHIIQGIRSETGAQIRVLSNDHIPACAINGDELLQISGDAVVVRKALHQVSSRLHDNPSKSQHLLASSLTQPYAGSSHLGSSSSAPVVGITPVIPAYGGYKGEVAGDWPSVYQPRRDESSAKEFSLRLLCAAANVGGVIGKGGGIIKQIRQESGAFIKVDSSNSGAEDDCIITVSAKEFFEDPVSPTIDAAIRLQPRCSEKSDAESAEPSYTTRLLVSTSRIGCLIGKGGSIITEIRRHSRANIRILSKENVPKVAAEDEEMVQISGGLDVARHALLQIAARLKANFFEREGALSAFPPVIPYHPLPAGVSDEPKYLSRDTKPVGHYLYSSGFRGSDDMIPSDSYGSYSSSQAPGGGYGAYSGYSGRSTNSGLSGHSSLPYGKRHGY

SEQ ID NO: 7471 - protein, 209 aa, Panicum virgatum
MAGHRNSHGKRHSDYAENGGGKRRNPGDDSYAPGPDDTVYRYLCSSRKIGSIIGRGGEIAKQLRTETQAKIRIGESVPGCEERVITIFSSSRETNTIDDAEDKVCPAQDALFRVHERLASDEGPGNEDSEEVVPQVTVRLLVPSDQIGCIIGKGGHIIQGIRSETGAQIRVLSNDHIPSCAINGDELLQISRGCCSCQKGSSSSVISPP

SEQ ID NO: 7472 - protein, 512 aa, Setaria italica
SYAPGPDDTVYRYLCASRKIGSIIGRGGEIAKQLRAETQAKIRIGESVPGCEERVITIFSSSRETNTIDDAEDKVCPAQDALFRVHERLASDEGPGNEDSEEVLPQVTVRLLVPSDQIGCIIGKGGHIIQGIRSETGAQIRVLSNDHIPACAINGDELLQISGDAVVVRKALHQVSSRLHDNPSKSQHLLASSLTQPYAGSSHLGSSSSAPVVGITPVIPAYGGYKGEVAGDWPSVYQPRRDESSAKEFSLRLLCAAANVGGVIGKGGGIIKQIRQESGAFIKVDSSNSGAEDDCIITVSAKEFFEDPVSPTIDAAIRLQPRCSEKSDAESAEPSYTTRLLVSTSRIGCLIGKGGSIITEIRRHSRANIRILSKENVPKVAAEDEEMVQISGGLDVARHALLQIAARLKANFFEREGALSAFPPVIPYHPLPAGVSDEPKYLSRDTKPVGHYLYSSGFRGSDDMIPSDSYGSYSSSQAPGGGYGAYSGYSGRSTNSGLSGHSSLPYGKRHGY

SEQ ID NO: 7473 - protein, 517 aa, Pennisetum glaucum
GGRRRNPGDDSYAPGPDDTVYRYLCASRKIGSIIGRGGEIAKQLRTETQAKIRIGESVPGCEERVITIFSSSRETNTIDDMEDKVCPAQDALFRVHERLASDESPGNEDIEEVAPQVTVRLLVPSDQIGCIIGKGGHIIQGIRSETGAQIRVLSNDHIPACAINGDELLQISGDAVVVRKALRQVSSRLHDNPSKSQHLLASSLMQPYAGSSHLGSSSSAPVVGITPVIPAYGGYKGDVAGDWPSVYQPRRDESSAKEFSLRLLCAAANVGGVIGKGGGIIKQIRQESGAFIKVDSSNSGAEDDCIITVSAKEFFEDPVSPTIDAAIRLQPRCSEKSDAESAEPSYTTRLLVSTSRIGCLIGKGGSIITEIRRSSRANIRILSKENVPKVAAEDEEMVQISGGLDVARHALLQIAARLKANFFEREGALSAFPPVIPYHPLPAGVSDEPKYISRDTKPVGHYLYSSGFRGSDDLIPSDSYGSYSSSQPSGGGYGAYSGYSGRTTSSGSLPYAKRHGY

SEQ ID NO: 7474 - protein, 542 aa, Oryza sativa
MVGPGHRNSHGKRHSDYAENGGGKRRNPGDDTYAPGPDDTVYRYLCPSRKIGSIIGRGGEIAKQMRADTQAKIRIGESVSGCDERVITIFSSSRETNTLVDAEDKVCPAQDALFRVHEKLSIDDDIGNEESDEGLAQVTVRLLVPSDQIGCIIGKGGHIIQGIRSDTGAHIRVLSNENLPACAISGDELLQISGDSTVVRKALLQVSSRLHDNPSRSQHLLASSMTQPYPVGSHLGSSSTAPVVGITPLISSYGGYKGDVAGDWPSIYQPRREESSAKEFSLRLLCAASNVGGVIGKGGGIIKQIRQESGAFIKVDSSNTEDDCIITVSAKEFFEDPVSPTINAAVHLQPRCSEKTDPESAIPSYTTRLLVSTSRIGCLIGKGGSIITEIRRTSRANIRILSKENVPKVAAEDEEMVQISGDLDVVRHALLQITTRLKANFFEREGALSGFPPVIPYHPLPVGVSEGPKYLGRDTKPLGHDYPYSSGYRGSDDIGPIDSYASYGSSQVSGGGYGAYGGYSGRSGSSGLSGPSSFSYGKRHGY

SEQ ID NO: 7475 - protein, 538 aa, Avena sativa
MVGPGHRNSHGKRHSDYAENGGGKRRNPGDDTYAPGPDDTVYRYLCVSKKIGSIIGRGGEIAKQLRNETQAKIRIGESVPGCDERVITIFSPTEETNTIEDTEDKVCPAQDALFRVHEKLATDDGPVNEENEEGLAQVTVRLLVPSDQIGCIIGKGGHIIQGIRSDTGSQIRVLSNEHLPACAISGDELLQISGDPMVVRKALLQVSSRLRDNPSRSQHLLASSLTQPSRVGSSSTAPVVGITSMVSPYGGYKGDMVGDWPSIYQPRREESSAKEFSLRLLCAPANVGGVIGKGGGIIKQIRQESGAFIKVDSSNLEDDCIITVSAKEFFEDPVSPTIDATVRLQPKCSEKIDAESGEPSYTTRLLVSTSRIGCLIGKGGSIITEIRRTSRANIRIFSKENVPKVASEDEEMVQISGDLDVARHALVQITTRLKANFFEREGALSGFPPVIPYHPLPASVSDEPRYLGRDNKPVGHDYLYSSGYRASDDMPPLDRYTNYGSSQVSGGGYGGYSGYSGRSGSSGLSGSTYLSSGKRYGY

SEQ ID NO: 7476 - protein, 542 aa, Brachypodium distachyon
MVGPGHRNSHGKRYSDYAENGGGKRRNPGDDTYAPCPDDTVYRYLCASRKIGSIIGRGGEIAKQLRTDTQAKIRIGESVPGCDERVITIFSSSRETNTVEDTEDKVCPAQDALFRVHEKLITDDGPGDEENEEGLAQVIVRLLVPSDQIGCIIGKGGHIIQGIRSDTGSHIRVLSTEHLPACAISGDELLQISGDPLVVRKALLQVSSRLHDNPSRSQHLLASSLTQPYPVGSRHGSSSTTPVVGIAPMVNPYGGYKGDMVGDWPSIYQPRREESSAKEFSLRLLCAASDVGGVIGKGGGIIKQIRQESGAFIKVDSSSAEDDCIITVSAKEFFEDPVSPTIDATVRLQPKCSEKTDPESGEPSYTTRLLVSTSQIGCLIGKGGSIITEIRRTSRANIRILSKENVPKVASEDEEMVQISGDLEVARHALVQITTRLKANFFEREGALSGFQPVIPYHPMPASISDEPKYLGRDTKPAGHDYPYSGGYRASEDMLPVDSYANYGSSQISGGGYGAYSGYSGRSGSSGLSGPSYLTSGKRYGY

SEQ ID NO: 7477 - protein, 542 aa, Brachypodium distachyon
MVGPGHRNSHGKRHSDYSENGGGKRRNPGDDTYAPGPDDTVYRYLCTSRKIGSIIGRGGEIAKQLRTDTQAKIRIGESVPGCDERVITIFSSSRETNTIEDTEDKVCPAQDALFRVHEKLIADDGPGDEENEEGLAQVTVRLLVPSDQIGCIIGKGGHIIQGIRSDTGSQIRVLSNERLPACGISGDELLQISGDPLVVRKALLQVSSRLHDNPSRSQHLQAPSLMQPYPVGSRNGSSSTAPVVGIAPMVSPYGGYKGDMVGDWPSIYQPRREDSSAKDFSLRLLCAASDVGGVIGKGGGIIKQIRQESGAFIKVDSSSAEDDCIITVSAKEFFEDPVSPTIDATVRLQPKCSEKTDPESGEPSYTTRLLVSTSQIGCLIGKGGSIITEIRRTSRANIRILSKENVPKVASEDEEMVQISGDLEVARHALVQITTRLKANFFEREGALSGFQPVIPYHPMPASISDEPKYLGRDTKPAGHDYPYSGGYRASEDMLPVDSYANYGSSQISGGGYGAYSGYSGRSGSSGLSGPSYLTSGKRYGY

SEQ ID NO: 7478 - protein, 538 aa, Brachypodium distachyon
MVGPGHRNSHGKRYSDYAENGGGKRRNPGDDTYAPCPDDTVYRYLCASRKIGSIIGRGGEIAKQLRTDTQAKIRIGESVPGCDERVITIFSSSRETNTVEDTEDKVCPAQDALFRVHEKLITDDGPGDEENEEGLAQVIVRLLVPSDQIGCIIGKGGHIIQGIRSDTGSHIRVLSTEHLPACAISGDELLQISGDPLVVRKALLQVSSRLHDNPSRSQHLLASSLTQPYPVGSRHGSSSTTPVVGIAPMVNPYGGYKGDMVGDWPSIYQPRREESSAKEFSLRLLCAASDVGGVIGKGGGIIKQIRQESGAFIKVDSSSAEDDCIITVSAKEFFEDPISPTIDATVRLQPRCSEKTDPESGEPSYTTRLLVSTSRIGCLIGKGGSIITEIRRTSRANIRILSKENVPKVASEDEEMVQISGDLDVAKHALVQITTRLKANFFEREGSLSGFQPVIPYHPLPASVADESKYLGRDAKLGHDYPYSGGYRASEDMLPVDSYANYGSSQVSGGRYGTYSGRSGSSGLSGPSYLSSGKRYGY

SEQ ID NO: 7479 - protein, 539 aa, Triticum aestivum
MVGPGHRNSHGKRQSDYAENGGGKRRNPGDDTYAPGPDDTVYRYLCTSRKIGSIIGRGGEIAKQLRSDTQAKIRIGESVPNCDDRVITIFSSSRETNTIEDTEDKVCAAQDALFRVHEKLATDDGPVNEENEEGLGQVTVRLLVPSDQIGCIIGKGGHIIQGIRSDTGSQIRVLSNEHLPACATSGDELLLIIGDPMVVRKALLQVSSRLHGNPSRSQHLLASSLTQPFPAGSRLGSSSTAPVVGITPMVSPYGRYKGDMVGDWPSIYQQRREVSSAKEFSLRLLCAAANVGGVIGKGGGIIKQIRQESGAFIKVDSSSAEDDCIITVSAKEFFEDPVSPTIDATVRLQPRCSEKIDAESGEPSYTTRLLVSTSRIGCLIGKGGSIITEIRRTSRANIRIISKEDVPKVASDDEEMVQISGDLDVARHALVQITTRLKANFFEREGALSGFPPVIPYHPLPASVSDEPKYLSRDNKSAGHDYPYSSGYRASDDVLPVDRYANYGSSQVYGGGYGAYSGGSGSSGLSGSTYLSSGKRYGY

SEQ ID NO: 7480 - protein, 524 aa, Zea mays
MAVKVLLSLCCVGACGLAVYLYHILWLVPQKVLAKFEDQKIGGPRPSFPYGNLADMREAAAAAKAARASARSSGSGGGGGGGIVHDYRPAVLPYYEKWRKEYGPIFTYSMGNVVFLHVSRPDVVRDINLCVSLDLGKSSYLKATHEPLFGGGILKSNGEAWLHQRKIIAPEFFLDKVKGMVDLMVDSAQPLLMSWEERVDRNGGITDIKIDDDIRAYSADVISRTCFGSSYIKGKEIFMKIRELQQAVSKPNVLAEMTGLRFFPSMRNKQAWELHKQVRKLILEIVKESGEDRNLLSAILHSASTSRVGIAEAENFIVDNCKSIYFAGHESTAVTAAWCLMLLGLHPEWQNRVREEVHEVCRGQPVDSRSLQKMKNLTMVIQETLRLYPAGAFVSRQALQELKLGGVHIPKGVNIYIPVSTMHLDPELWGPDVKEFNPERFSDVRPQLHSYLPFGAGARTCLGQGFAMAELKILISLIVSKFVLKLSPHYQHSPTLKLIVEPELGVDLTLTKVQSVCTKRGTAI

SEQ ID NO: 7481 - protein, 520 aa, Setaria italica
MEQVAMAVKVLLSLCCVGACGLAVYLYYILWLVPQRVLAEFRRQGIGGPRPSFPYGNLADMREAVATAKAARASARRPGCCCGGGGIVHDYRPAVLPYYEKWRKEHGPIFTYSMGNVVFLHVSRPDVVRDINLCVSLDLGKSSYLKATHEPLFGGGILKSNGEAWLHQRKIIAPEFFLDKVKGMVDLMVDSAQPLLKLWEERVDRNGGITDIKIDDDIRAYSADVISRTCFGSNYIKGKEIFIKIRELQQAVSKPNVLAEMTGLRFFPSTRNKQAWELHKEVHKLILEIVKESGEDRNLLSAILHSASYSRVGIAEAENFIVDNCKSIYFAGYESTAVTAAWCLMLLGLHPEWQDRVRAEVHEVCRGRPLDSQSLQKMKNLTMVIQETLRLYPAGAFVSRQALQDLKLGGVHIPKGVNIYIPVSTMHLDPKLWGADVKEFNPERFSDVRPQLHSYLPFGAGARTCLGQGFAMAELKILISLIISKFILKLSPHYEHSPTLKLIVEPELGVDLTLTKVQCL

SEQ ID NO: 7482 - protein, 521 aa, Panicum virgatum
MEQVAMAVKVLLSLCCVGACGLAMYLYHTLWLVPQRVLAEFRMQGIGGPPPSFPYGNIADMREAVAAAKAARASARRAAAGAGAGGIRHDYRPAVLPYYEKWRKEHGPIFTYSMGNVVFLHVSRPDVVRDINLCVSLDLGKSSYLKATHEPLFGGGILKSNGEAWLHQRKIIAPEFFLDKVKGMVDLMVDSAQPLLKSWEERVDRNGGVTDIKIDDDIRAYSADVISRTCFGSSYIKGKEIFMKIRELQQAVSKPNVLAEMTGLRFFPSMRNKQAWELHKEVRQLILEIVKESGEDRNLLSAILHSASCSRVGIAEAENFIVDNCKSIYFAGHESTAVTAAWCLMLLGLHPEWQDRVRAEVHEVCRGRPVDSQSLQKMKKLTMVIQETLRLYPAGAFVSRQALQDLKLGGVHIPKGVNIYIPVSTIHLDPELWGADVKEFNPERFSDVKPQLHSYLPFGAGARTCLGQGFAMAELKILISFIISKFVLKLSPHYEHSPTLKLIVEPELGVDLTLTKVQCLY

SEQ ID NO: 7483 - protein, 517 aa, Hordeum vulgare
MEVGMVMKVLLGLCCVGACSLALYLYYTVWVVPQRLLAGFRRQGIGGPRPSFPYGNMADMREAVAAAKSARRSGGRMRIVHDYRPAVLPFYEKWRKEHGPVFTYSMGNVVFLHVSRPDVVRDINLCVSLDLGKSSYLKATHEPLFGRGILKSNGEAWAHQRKIIAPEFFLDKVKGMVDLMVDSAQTLLESWEARVDKSGGTVDIKIDDDIRAYSADVISRTCFGSSYVKGKKIFLKLRELQKAVSKPNVLAEMTGLRFFPTKKNRQAWGLHKQVHRLILEIVKESGEDKNLLRAILHSASSSKVGLGEAENFIVDNCKSIYFAGYESTAVTAAWCLMLLGLHPEWQDRVRQEVLEVCGGRPLDSQSLQKMKNLTMVIQETLRLYPAGAFVSRMALQELKLGGVHIPKGVNIYIPVSTMHLDPKLWGPDAKEFNPARFSDARPQLHSYLPFGAGARTCLGQGFATAELKILISLIISKFALRLSPLYQHSPALKLIVEPEFGVDITLTKVQTASTTTY

SEQ ID NO: 7484 - protein, 513 aa, Brachypodium distachyon
MEVGMVMKASLSLCCVGACCLALYLYYIVWVVPQRLLAGFRRQGIGGPRPSFPYGNLADMKEAVAAAKVASRGVGGIVHDYRPAVLPFYEKWRKEHGPVFTYSMGNVVFLHVSRPDVVRDINLCVSLDLGKSSYLKATHEPLFGRGILKSNGQAWAHQRKIIAPAFFLDKVKGMVDLMVDSAQTLLKSWEERVDGNGGTVNIKIDDDIRAYSADVISRTCFGSSYIKGKKIFLKLRELQKAVSKPNVLAEMTGLRLFPTKKNRQAWELHRQVHKLILEIVKESGEDKNLLSTILHSASSSKVGLGEAENFIVDNCKSIYFAGYESTAVTAAWCLMLLGLHPEWQDKVREEVQEVCGGRPIDSQSLQKMKNLTMVIQETLRLYPAGAFVSRMALQELKLGGVNIPKGVNIYIPVSTMHLDPKLWGADVKEFNPERFSDARPQLHSYLPFGAGARTCLGQGFATAELKILISLIISKFALKLSPLYEHSPTLKLVVEPEFGVDLTLTKVQGACRC

SEQ ID NO: 7485 - protein, 515 aa, Secale cereale
MEVGMVMKVLLSLSCVGACSLALYLYYTVWVVPQRLLAGFRRQGIGGPRPSFPYGNINDMREAVATAKSARPAGGRIIHDYRPAVLPFYEKWRKEHGPVFTYSMGNVVFLHVSRADVVRDINLCVSLDLGKSSYLKATHEPLFGRGILKSNGEAWAHQRKIIAPEFFLDKVKGMVDLMVDSAQTLLESWEAMVDKNGGTVDIKIDDDIRAYSADVISRTCFGSSYVKGKKIFLKLRELQKAVSKPNVLAEMTGLRFFPTKKNRQAWGLHKQVHRLILEIVKESGEDKNLLRAILHSASSSKVGLREAENFIVDNCKSIYFAGYESTAVTAAWCLMLLGLHPEWQDRVRQEVLEVCGGRPADSQSLQKMKNLTMVIQETLRLYPAGAFVSRMALEELKLGGVHIPKGVNIYIPVSTMHLDPKLWGPDAKEFNPARFSDARPQLHSYLPFGAGARTCLGQGFATAELKILISLIISKFALKLSPLYHHSPALKLIVEPEFGVDLTLTKVQTASTTTY

SEQ ID NO: 7486 - protein, 781 aa, Setaria italica
MEAMTGGKFLQKFRLYETRSKFYLIGRDKSRAHWRVLKIDRMECTELGVEEDPTIYTESECQELLWRIHEGNRLTGGLKFVTKCYGIVGFVKFLGPYYMVVITRRRKVGTICGHEIYSIGKSEMITIPSVIVWPNVAYSRDENRYKRLLCSVDLSKDFFFSYSYNIMRSLQKNITEKNTGQVVYETMFVWNEFLTRAIRNHLKNTSWTVALVHGFFKQSKLSVSGKDFWLTLIARRSRHFAGTRFLKRGVNEKGRVANDVETEQIVFEDTSDGIPSHMASVVQHRGSIPLVWFQETSRLNIRPDIILKADVDYKATRLHFENLALRYGNPIIILNLIKTREKKPRESLLRAEFAKAIHYINKGLTEDKRLKFLHMDLSKLSRRKGTNVLALLNKVASDVLDLTEFLHCKISTSAKSEDATSGERTVTKPHDDKSSSVQSECVAKLVPILLQKGVLRTNCIDCLDRTNVAQFAYGLAALRRQLHALGLTEAPKIELHAPLADDLMDFYERMGDTLAIQYGGSAAHNKIFCEQRGQWKAATQSQEFLRTLQRYYNNAYTDHDKQDAINVFLGHFQPQQGKPALWKLDSDQHYNIGRQGTLKEEIARSFIKRSLSDGNILLENSLPVSNCNSGENNTALLPMQQLDDIREPSDSAPDISICEPNPCSSMNYGTVPARHSMSEERQSYLKRLGYPELHSSNFLDLDLLSSSGNSCDEEVFERSSLINSPMDEISVESSTSYSEQGHLDEGRDDTDLSRSSSQLSDTRDYSDRFAHWVANGGMLCY

SEQ ID NO: 7487 - protein, 781 aa, Pennisetum glaucum
MEAMTGGKFLQKFRLYETRSKFYLIGRDKSRAHWRVLKIDRTECTELGVEEDPTIYTESECQELLWRIHEGNRLTGGLKFVTKCYGIVGFVKFLGPYYMVVITRRRKVGTICGHEIYSIGKSEMIAIPSVIVWPNVAYSRDENRYKRLLCSVDLSKDFFFSYSYNIMRSLQKNIIEKNTGQVVYETMFVWNEFLTRAIRNHLKNTSWTVALVHGFFKQSKLSVSGKDFWLTLIARRSRHFAGTRFLKRGVNEKGRVANDVETEQIVFEDTSDGIPSHMASVVQHRGSIPLVWFQETSRLNIRPDITLKADVDYKATRLHFENLALRYGNPIIILNLIKTREKKPRESLLRAEFAKAIHYINKGLTEDKRLKFLHMDLSKLSRRKGTNVLALLNKVASDVLDLTEFLHCEIATSVKSEDAASGERTVTKPHDDKSSSVQSECAAKLVPILLQKGVLRTNCIDCLDRTNVAQFAYGLAALGRQLHALELTEAPKIELHAPLADDLMDFYERMGDTLAIQYGGSAAHNKIFCEQRGQWKAATQSQEFLRTLQRYYNNAYTDHDKQDAINVFLGHFQPQQGKPALWKLDSDQHYNIGRQGTLKEEIARSFIKRSLSDGNILLDNSLPVSNCNSGENNTVLLPMQQLDDIREPSDSAPDISICEPSPCSSMKYGTVSARHSMSEERQSYLKRLGYPELHSSNFLDLDLLSSSGNSCDEEVFERSSLINSPMDEISVDSSTSYSEQGHADEGRDDTDLSRSSSQLSDTRDYSDRFAQWVATGGMLCY

SEQ ID NO: 7488 - protein, 789 aa, Zea mays
MEAMTGGKFLQKFRLYETRSKFYLIGRDKSRIHWRVLKIDRSEFTELGVEEDPTIYTENECQELLRRIHEGNRLTGGLKFVTKCYGIVGFVKFLGPYYMVIITRRRKIGTICGHEIYSVGKSEMIAIPSVTVWPNMAYSRDENRYKHLLCSVDLSKDFFFSYSYNIMHSLQKNITEKNIGQVYETMCVWNEFMTRAIRDHLMNTCWTVALVHGFFKQSRFSVSGKDFWLTLIARRSRHFAGTRFLKRGVNGKGRVANDVETEQIVFEDTSGGIPTQMASVVQHRGSIPLVWFQETSRLNIRPDIILKPDLDYKATRLHFENLALRYGNPIIILNLIKASAASLLFDTHEKKPRESLLCAEFAKAIHYINKSLSDDKCLKFLHMDLSNLFRRKGTNVLALLSKVASDVLDLTEFLHCEISTSTKSDDISSEEKTVAKPRDDRSSRDQTECAAKLVPLLLQKGVLRTNCIDCLDRTNVAQFSYGLAALGRQLHALGLAEAHKIELHDPLVDDLMDFYERMGDTLAIQYGGSAAHNKIFCEQRGQWKATTQSQEFLRTLQRYYNNAYTDHEKQDAINMFLGHFQPQQGKPALWKLDSDQHYNIGRQGTLKEEIGRSFIKRSLSDGNILLESSLPVTICNNETDNTELLPVQQLDDIREASDSAPEISICEPNLCSSMNYGTVPGRHSMSEERQSYLKRLGYPELHSSNFFDLDLLSSSGNSFDEEVFERSLLINSPMDVISPESSMSYSEQGHTDEGRDDTDLSRSSSQLSDIRDYSDHFAQWVVNGDTLCY

SEQ ID NO: 7489 - protein, 711 aa, Saccharum officinarum
GNKLTGGLKFVTKCYGIVGFVKFLGPYYMVIITRRRKIGTICGHEIYSVAKSEMIAIPSVIVWPNVAYSRDENRYKRLLCSVDLSKDFFFSYSYNVMRSLQKNITEKNTGQVVYETMCVWNEFLTRAVRNHLKNTCWTVALVHGFFKQSKLSVSGKDFWLTLIARRSRHFAGTRFLKRGVNEKGRVANDVETEQIVFEDTSDGIPTQIASVVQHRGSIPLVWFQETSRLNIRPDIILKPDVDYKATRLHFENLALRYGNPIIILNLIKTREKKPRESLLRAEFAKAIHYINKSLPDDKRLKFLHMDLSKLSRRKGTNVLALLNKVASDVLDLTEFLHCEISTSTKPDDTSSGEETVAKPRDDRSSRDQTECAAKLAPRLLQKGVLRTNCIDCLDRTNVAQFAYGLVALGRQLHVLGLTEAQKIELHDPLADDLMDFYERMGDTLAIQYGGSAAHNKIFCEQRGQWKAATQSQEFLRTLQRYYNNAYTDHEKQDAINMFLGHFHPQQGKPALWKLDSDQHYNIGRQGTLTEEIGRSFIKRSLSDGNIMLENSLPITNCNNETNNTELLPMQQLDDIREPSDSAPEISICEPNPCSSMNYGTVPGRHSMSEERQSYLKRLGFPELHSSNFLDLDLLSSSGNSCDEEVFERSSLINSPLDVISVESSTSYSEQGHIDEGRDDTDLSRSSSQLSDVRDYSDRFAHWVANGGMLCY

SEQ ID NO: 7490 - protein, 462 aa, Zea mays
MEAMTGGKFLQKFRLYETRSKFYLIGRDKSRIHWRVLKIDRLESTELGVDEDPTIYTESECQELLWRIHEGNMLTGGLKFVTKCYGIVGFVKFLGPYYMVIITSRRKIGTICGHEIYSVGKSEMIAISSVTVWPNVAYSRDENRYKRLLCSVDLSKDFFFSYSYNIMRSLQKNITQKNTGQAVYEPMCVWNEFLTRAIRNHLKNTCWTVALVHGFFKQSKLSVSGKDFWLTLIARRSRHFAGTRFLKRGVNEKGRVANDVETEQIVFEDTSDGIPTQMASAVQHRGSIPLVWFQETSRLNIRPDIILKPDVDYKATRLHFENLALRYGNPVIILNLIKASAASMLFDTREKKPRESLLRAEFAKAIHYINKSLPDDKRLKFLHMDLSKLSRRKGTNVLALLTKVASDVLDLTEFLHCEISTSTKPDDTSSGERTAAKPHDDRSSSDQTECAAKASTSCIGAY

SEQ ID NO: 7491 - protein, 782 aa, Oryza sativa
MEAMAGDKFLQKFRLYETRSKFYLIGRDKTRTLWRVLKIDRMEPTELEIEEDHTSYTENECQELLWRIHEGNRLTGGLKFVTKCYGIVGFIKFLGPYYMVLITRRRKVGTICSHEIYSVGKSELIAIPSPIVWPNVAYSRDENRYKRLLCSVDLSKDFFFSYSYNIMRSLQKNITDKNTGQVVYETMFVWNEFLSRAIRNHLKNTTWTVALIHGFFKQSKLSVAGKEFWLTLIARRSRHFAGTRFLKRGVNEKGRVANDVETEQIVFEDTPDEIPHQISSVVQHRGSIPLIWFQETSRLNIRPDIILKPDVDYKTTRLHFENLALRYGNPIIILNLIKTREKKPRESLLRAEFAKAIHYINKGLPDDKRLKFLHMDLSKLSRRKGTNVLSLLNKVASDVLDLTDFLHCEITTSKYEDASSGQGAVANSGDIENIQDQNLCATKLVPLLLQKGVLRTNCIDCLDRTNVAQFAYGLAALGRQLHVLQLNETPTIELHAPLADDLMDFYERMGDTLAIQYGGSAAHNKIFCEQRGQWKAATQSQEFLRTLQRYYSNAYTDPEKQDSINVFLGHFQPQEGKPALWKLDSDQHYNIGRQGTLTEETGRSFIKRSLSDGNILCDNTGGPVSDCNVGKNNTSSELLPMQPLEDIREPSDSAPEISIEPNPCSSTNYSTLSGRHSISEERQNYLRRLGYPELHSSNFLDLDLLSSSGNSCEEEIYERSSLINSPMDVVSIESTTSYSEQGHNDEGRDDTDLSRSSSQMSDIRDYSDRFTHWVDGGGMLCY

SEQ ID NO: 7492 - protein, 783 aa, Oryza sativa
MEAMAGDKFLQKFRLYETRSKFYLIGRDKTRTLWRVLKIDRMEPTELEIEEDHTSYTENECQELLWRIHEGNRLTGGLKFVTKCYGIVGFIKFLGPYYMVLITRRRKVGTICSHEIYSVGKSELIAIPSPIVWPNVAYSRDENRYKRLLCSVDLSKDFFFSYSYNIMRSLQKNITDKNTGQVVYETMFVWNEFLSRAIRNHLKNTTWTVALIHGFFKQSKLSVAGKEFWLTLIARRSRHFAGTRFLKRGVNEKGRVANDVETEQIVFEDTPDEIPHQISSVVQHRGSIPLIWFQETSRLNIRPDIILKPDVDYKTTRLHFENLALRYGNPIIILNLIKTREKKPRESLLRAEFAKAIHYINKGLPDDKRLKFLHMDLSKLSRRKGTNVLSLLNKVASDVLDLTDFLHCEITTSKYEDASSGQGAVANSGDIENIQDQNLCATKLVPLLLQKGVLRTNCIDCLDRTNVAQFAYGLAALGRQLHVLQLNETPTIELHAPLADDLMDFYERMGDTLAIQYGGSAAHNKIFCEQRGQWKAATQSQEFLRTLQRYYSNAYTDPEKQDSINVFLGHFQPQEGKPALWKLDSDQHYNIGRQGTLTEETGRSFIKRSLSDGNILCDNTGGPVSDCNVGKNNTSSELLPMQPLEDIREPSDSAPEISIEPNPCSSTNYSTLSGRHSISEERQNYLRRLGYPELHSSNFLDLDLLSSSGNSCEEEIYERSSLINSPMDVVSIESTTSYSEQGHNDEQGRDDTDLSRSSSQMSDIRDYSDRFTHWVDGGGMLCY

SEQ ID NO: 7493 - protein, 781 aa, Brachypodium distachyon
MESIRGGKFLQKFRLYETRSKFYLIGRNKSRTIWKVLKIDRLESTDLGIQEDPTCYTENECQELLWRIHEGNRLTGGLKFVTKCYGIVGFMKFLGPYYMVIITRRRKVGTICGHDIYSIGKSEMIAIPCPIVWPNVANSRDENRYKRLLCSVDLTKDFFFSYSYNIMRSLQKNIADKNTGQVVYETMFVWNEFLTRAMRSHLKNTNWTVALIHGFFKQSKLSVCGKDFWLTLIARRSRHFAGTRFLKRGVNEKGRVANDVETEQIVFEDTPDDIPCEITSVVQHRGSIPLVWFQETSRLNIRPEITLKPDVDYKATRLHFENLALRYGNPIVILNLIKTREKKPRESLLRAEFAKAIHYINKGLPDDKRLKFLHMDLSKLARRKGTNVLGLLNKVASDVLELTDLLHCEITTSKPRGASSGQGDVTESCEIKSNDDFCADMMVPLLLQKGVLRTNCIDCLDRTNVAQFAYGLTALGRQLHVLRLTQEPKIELHAPLADDLMDFYERMGDTLAIQYGGSAAHNKIFCEQRGQWKAATQSQEFLRTLQRYYNNAYTDPEKQDAINVFLGHFQPQQGRPALWKLDSDQHYNIGRQGTVNEESGRSFIKRSLSDGNILCENSVPISDRNVGENNTANSELLPMQQLDDIREPTDSAPEIYMCETNPCSSTKYSTMPGRHSISEERQSYLKRLGYPELHSSNFLDLDLLSSSGNSCDEEAFERSSLIHSPMDVISVESATTYSEQGHNDEGRDDTDLSRSSSQLSDSRDYSDRFAQWVANGGMLCY

SEQ ID NO: 7494 - protein, 775 aa, Hordeum vulgare
MEAMRGGKFLQKFRLYETRSKFYLVGRDKSRTLWRVLKIDRLESTDLGIQEDPTSYTENECQELLWRIHEGNRLTGGLKFVTKCYGIIGFMKFLGPYYMVVITRRRKVGTICGHDIYSIGKSEMIAIPCPIVCPNVANSRDENRYKRLLCSVDLTKDFFFSYSYNIMRSLQKNINDKNTGHVVYETMFVWNEFLTRAMRNHLKNTDWTVALVHGFFKQSKLAVSGKDFWLTLIARRSRHFAGTRFMKRGVNEKGRVANDVETEQIVFEDTPDDIPSQITSVVQHRGSIPLVWFQETSRLNIRPEITLKSDVDYKATRLHFENLVLRYGNPIVILNLIKTREKKPRESLLRAEFAKAIHYINKGLPDDERLKFLHMDLSKLSRRKGTNVLGLLNKVASDVLELTDLLHCEITTSSKPLDASSGQGSSDIKRNDDFCAATMVPLLLQKGVLRTNCIDCLDRTNVAQFAYGLAALGRQLHVLKLTEEPKIDLHDPLADDLMDFYERMGDTLAIQYGGSAAHNKIFCEQRGQWKAATQSQEFLRTLQRYYNNAYTDPEKQDAINVFLGHFQPQQGKPPLWKLDSDQHYNIGRQGTLSEETGRFIKRSLSDGNILCENSAPVSDRNVGENNTANSELLPVQQLDDIREPTDSAPEIYMCETNPCPSTKYSTMPGRHSISEERQSYLKRLGYPELHSSNFLDLDLLSSSGNSCDEEAFERSSLIHSPLDGISVGSTTTYSEPGHNDEGRDDLSRSSSQLSDSRDYSDRFAQWVANGGMLCY

SEQ ID NO: 7495 - protein, 782 aa, Avena sativa
MEAMRGGKFLQKFRLYETRSKFYLVGRDKSRTLWRVLKIDRLETTDLGIEEDPTSYTENECQELLWRIHEGNRLTGGLKFVTKCYGIVGFMKFLGPYYMVVITRRRKVGTICGHDIYSIGKSEMIAIPCPIVWPEVANSRDENRYKRLLCSVDLTKDFFFSYSYNIMRSLQKNITAKNTGQVVYETMFVWNEFLTRAMRNHLKNTNWTVALIHGFFKQSKLSVSGKDFWLTLIARRSRHFAGTRFLKRGVNEKGRVANDVETEQIVFEDTSDDIPCQITSSVQHRGSIPLVWFQETSRLNIRPEITLKPDVDYKATRLHFENLVLRYGNPIVILNLIKTREKKPRESLLRAEFAKAIHYINKGLPDDKRLKFLHMDLSKLSRRKGTNVLSLLNKVASDVLELTDILHCEITTSSKPLDASSGQGCVIKSCDVESNDDLCTSTLVPLLLQKGVLRTNCIDCLDRTNVAQFAYGLAALGRQLHVLGLTEAPKIELHAPLADDLMDFYERMGDTLAIQYGGSAAHNKIFCEQRGQWKAATQSQEFLRTLQRYYNNAYTDPEKQDAINVFLGHFQPQQGKPALWKLDSDQHYSIGRQGTVGEETVRPLIKRSFSVGNILCENSGAVSDCNAVDNNNANSELLPIQQLDDIREPTDSAPEIYMCETNPCSSTKYSAMPGRHSISEERQSYLKRLGYPELHSSNFLDLDLLSSSGNSCDEEAFERSSLIHSPTDLISVESTTTYSEQGHNDEGRYDTDLSRSSSQLLDSGDYSESFAQWVANGGMLCY

SEQ ID NO: 7496 - protein, 603 aa, Secale cereale
MTKILDMLFMKQCLYGMNFCTRAMRNHLKNTDWTVALVHGFFKQSKLSVPGKDFWLTLIARRSRHFAGTRFMKRGVNEKGRVANDVETEQIVFEDTPDDIPSQITSVVQHRGSIPLVWFQETSRLNIRPEITLKSDVDYKATRLHFENLVLRYGNPIVILNLIKTREKKPRESLLRAEFAKAIHYINKGLPDDKRLKFLHMDLSKLSRRKGTNVLGLLNKVASDVLELTDLLHCEITTSSKPLDASSEQGSCDIKSNDEFCAATMVPLLLQKGVLRTNCIDCLDRTNVAQFAYGLAALGRQLHVLKLTEEPKIDLHDPLADDLMDFYERMGDTLAIQYGGSAAHNKIFCEQRGQWKAATQSQEFLRTLQRYYNNAYTDPEKQDAINVFLGHFQPQQGKPPLWKLDSDQHYNIGRQGTLSEETGRFIKRSLSDGNILCETSAPVSDRNVGENNTANSELLPVQQLDDIREPTDSAPEIYMCETNPCPSTKYSMMPGRHSISEERQSYLKRLGYPELHSSNFLDLDLLSSSGNSCDEEAYERSSIIHSPLDGISVGSTTTYSEPGHNDEGRDETDLSRSSSQLSDSRDYSDRFAQWVANGGMLCY

SEQ ID NO: 7497 - protein, 777 aa, Secale cereale
MEAMRGGKFLQKFRLYETRSRFYLVGRDKSRTLWRVLKIDRLESTDLGIQEDPTSYTENECQELLWRIHEGNRLTGGLKFVTKCYGIIGFMKFLGPYYMVVITRRRKVGTICGHDIYSIGKSEMIAIPCPIVCPNVANSRDENRYKRLLCSVDLTKDFFFSYSYNIMRSLQKNINDKNTGHVVYETMFVWNEFLTRAMRNHLKNTDWTVALVHGFFKQSKLSVPGKDFWLTLIARRSRHFAGTRFMKRGVNEKGRVANDVETEQIVFEDTPDDIPSQITSVVQHRGSIPLVWFQETSRLNIRPEITLKSDVDYKATRLHFENLVLRYGNPIVILNLIKTREKKPRESLLRAEFAKAIHYINKGLPDDKRLKFLHMDLSKLSRRKGTNVLGLLNKVASDVLELTDLLHCEITTSSKPLDASSEQGSCDIKSNDEFCAATMVPLLLQKGVLRTNCIDCLDRTNVAQFAYGLAALGRQLHVLKLTEEPKIDLHDPLADDLMDFYERMGDTLAIQYGGSAAHNKIFCEQRGQWKAATQSQEFLRTLQRYYNNAYTDPEKQDAINVFLGHFQPQQGKPPLWKLDSDQHYNIGRQGTLSEETGRFIKRSLSDGNILCETSAPVSDRNVGENNTANSELLPVQQLDDIREPTDSAPEIYMCETNPCPSTKYSMMPGRHSISEERQSYLKRLGYPELHSSNFLDLDLLSSSGNSCDEEAYERSSIIHSPLDGISVGSTTTYSEPGHNDEGRDETDLSRSSSQLSDSRDYSDRFAQWVANGGMLCY

SEQ ID NO: 7498 - protein, 777 aa, Secale cereale
MEAMRGGKFLQKFRLYETRSRFYLVGRDKSRTLWRVLKIDRLESTDLGIQEDPTSYTENECQELLWRIHEGNRLTGGLKFVTKCYGIIGFMKFLGPYYMVVITRRRKVGTICGHDIYSIGKSEMIAIPCPIVCPNVANSRDENRYKRLLCSVDLTKDFFFSYSYNIMRSLQKNINDKNTGHVVYETMFVWNEFLTRAMRNHLKNTDWTVALVHGFFKQSKLSVPGKDFWLTLIARRSRHFAGTRFMKRGVNEKGRVANDVETEQIVFEDTPDDIPSQITSVVQHRGSIPLVWFQETSRLNIRPEITLKSDVDYKATRLHFENLVLRYGNPIVILNLIKTREKKPRESLLRAEFAKAIHYINKGLPDDKRLKFLHMDLSKLSRRKGTNVLGLLNKVASDVLELTDLLHCEITTSSKPLDASSEQGSCDIKSKDEFCAATMVPLLLQKGVLRTNCIDCLDRTNVAQFAYGLAALGRQLHVLKLTEEPKIDLHDPLADDLMDFYERMGDTLAIQYGGSAAHNKIFCEQRGQWKAATQSQEFLRTLQRYYNNAYTDPEKQDAINVFLGHFQPQQGKPPLWKLDSDQHYNIGRQGTLSEETGRFIKRSLSDGNILCETSAPVSDRNVGENNTANSELLPVQQLDDIREPTDSAPEIYMCETNPCPSTKYSMMPGRHSISEERQSYLKRLGYPELHSSNFLDLDLLSSSGNSCDEEAYERSSIIHSPLDGISVGSTTTYSEPGHNDEGRDETDLSRSSSQLSDSRDYSDRFAQWVANGGMLCY

SEQ ID NO: 7499 - protein, 610 aa, Triticum aestivum
MRSLQKNINDKNTGHVVYETMFVWNEFLTRAMRNHLKNTDWTVALVHGFFKQSKLSVSGKDFWLTLIARRSRHFAGTRFMKRGVNEKGRVANDVETEQIVFEDTPDDIPSQITSVVQHRGSIPLVWFQETSRLNIRPEITLKSDVDYKATRLHFENLVLRYGNPIVILNLIKTREKKPRESLLRAEFAKAIHYINKGLPDDKRLKFLHMDLSKLSRRKGANVLGLLNKVASDVLELTDLLHCEITTSSKPLDASSGQGPCDIKINDDFCAATMVPLLLQKGVLRTNCIDCLDRTNVAQFAYGLAALGRQLHVLKLTEEPKIDLHDPLADDLMDFYERMGDTLAIQYGGSAAHNKIFCEQRGQWKAATQSQEFLRTLQRYYNNAYTDPEKQDAINVFLGHFQPQQGKPPLWKLDSDQHYNIGRQGTLSEETGRFIKRSLSDGNILCENSAPVSDRNVGENNTASELLPAQQLDDIREPTDSAPEIYMCETNPCPSTKYSTMPGRHSISQERQSYLKRLGYPELHSSNFLDLDLLSSSGNSCDEEAFERSSIIHSPLDGISVGSTTTYSEPGHNDEGRDDTDLSRSSSQLSDSRDYSDRFAQWVANGGMLCY

SEQ ID NO: 7500 - protein, 265 aa, Zea mays
MDGDAGPEQHGCVHYRRGCKIRAPCCGEVFGCRHCHNEAKDSLEVSVHDRHVLPRHDIKLVICSLCNKEQDVQQDCANCGACLGKYFCAKCNFFDDDVSKNQFHCDGCGICRTGGAENFYHCGRCGCCYTTTLKDSHRCVDGAMHHNCPVCMEYLFDSMKAISVLHCGHTIHLECLYEMRAHQQFSCPVCLRSACNMSDIWQKLDQQVAASPMPAIYQKKMVWILCNDCGVTSNVQFHILAHKCPGCSSYNTRQTRGDPAACSRV

SEQ ID NO: 7501 - protein, 263 aa, Panicum virgatum
MAAGPERYGCVHYRRKCKIRAPCCGEVFDCRHCHNEAKDSLEVSIHGRHVVPRHEIKLVICSLCNKEQDVQQDCSNCGACLGKYFCAKCNLFDDDVSKNQFHCDGCGICRTGGVENFYHCDKCGCCYTYLLKDSHRCVDRAMHQNCPVCFEYLFESTKAVSVLHCGHTIHLQCLYEMRAHQQFSCPVCLRSSCDMSDKWQKLDQEVAASPMPAICQKKMIWILCNDCGMTSNVQFHILAHKCPGCSSYNTRRTRGDQAACSRV

SEQ ID NO: 7502 - protein, 265 aa, Setaria italica
MDADTGPVQYGCVHYKRKCKIRAPCCGEIFDCRHCHNEAKDSLEVNNHERHVVPRHEIKLVICSLCNKEQDVHQDCSNCGACFGKYFCAKCNFFDDDVSKNQFHCDGCGICRTGGAENFYHCGKCGCCYTYQLKDSHRCVDGAMHHNCPVCFEYLFDSTKAVSVLHCGHTIHLQCLYEMRAHQQFSCPVCLRSACDMSDIWRKLDQEVAASPMPAICQKKMIWILCNDCGMTSNVQFHILAHKCPGCSSYNTRQTRGGPAACSRV

SEQ ID NO: 7503 - protein, 264 aa, Oryza sativa
MDLAVEQYGCVHYRRKCKIRAPCCGEIFDCRHCHNEAKDSLEVSISDRHEIPRHEIKLVICSLCNKEQDVQQDCSNCGACLGKYFCAKCNFYDDDVSKNQFHCDGCGICRTGGAENFFHCDKCGCCYSYVLKDSHHCVERAMHHNCPVCFEYLFDSTKDISALHCGHTIHLECLYEMRSHQQFSCPVCLRSACDMSHAWQKLDQEVAASPMPVIYQKKMIWILCNDCGTTSNVQFHILGHKCPGCSSYNTRQTRAAPAAACSRV

SEQ ID NO: 7504 - protein, 97 aa, Saccharum officinarum
MDADAGPERYGCVHYRRKCKIGRRAAARYLIADTATTKPRIHWRSASTTATWFPVTTSSWLSALSAIKNRMYSKIVQIVEHVSVNTSARNATSSMMM

SEQ ID NO: 7505 - protein, 653 aa, Brachypodium distachyon
MPTASRQRLCRAALLVAGAGYLAFLLLFEVPSLPFSSSSSSSAAASQQLPTHSSRRRELEASASTSPFSPARPSKPAFPAAGSPAPSPPPLPIFSSLLVLPRSNATATPFDGTAADAFAAAKPHLTHLRTAAASASVAASPPPSSPTCPASISLHADKLPANGVRTVELPCGLAVGSHVTVVARPRAARPEYDPQIAERKDGKTPLMVSQFMVELVGTKVVDGEAPPRILHFNPRIRGDYSGKPVIEMNSCYRMQWGRSQRCEGFASRPAEETVDDQLKCEKWIRDDDNKSEESKMKWWVKRLIGRPKDVHISWPYPFAEGKLFVLTLTAGLEGYHVNVDGRHVASFPYRTGYTLEDATGLSLNGDIDIESIFASSLPNSHPSFSPERYLEMSEQWRAPPLPTEPVELFIGILSAANHFAERMAVRKSWMMYTRKSSNIVARFFVALNGKKEVNAELKREAEFFHDIVIVPFMDSYDLVVLKTIAIAEYGVRVIPAKYVMKCDDDTFVRIDSVLDQVKKVQSDKSVYVGSMNYFHRPLRSGKWAVTYEEWPEEVYPNYANGPGYVISADIASYIVSEFDNQTLRLFKMEDVSMGMWVEKFNNTRRPVEYRHDVRFYQAGCYDGYFTAHYQSPQHMICLWRKLQSGSTHCCNVR

SEQ ID NO: 7506 - protein, 655 aa, Oryza sativa
MPPPPRKRLGRAALLLAAAAYLAFLLLFELPSLDLFPSSDAAAGAAMPTHRPRRRELEASSSSSAFASPVLRRPATAVSPAPASAAAAAAGALPIFSSLLLLPRPNATATPFDGTAAEAFAAARPHLDHLRTAAAAAAEEASSSSTAPTCPTSISVHADGLPGDGVRTVELPCGLAVGSHVTVVARPRAARPEYDPKIAERKSGQEPLMVSQFMVELVGTKAVDGEAPPRILHFNPRIRGDYSGKPVIEMNSCYRMQWGQSQRCEGYASRPADETVDGQLKCEKWIRDDDKKSEESKMKWWVKRLIGRPKDVHISWPYPFAEGKLFVLTLTAGLEGYHVNVDGRHVTSFPYRTGYTLEDATGLSLNGDIDIESIFASSLPNSHPSFAPERYLEMSEQWRAPPLPTEPVELFIGILSAASHFAERMAVRKSWMMYTRKSTNIVARFFVALNGKKEVNAELKREAEFFQDIVIVPFMDSYDLVVLKTIAIAEYGVRVIPAKYIMKCDDDTFVRIDSVLDQVKKVRSDKSVYVGSMNYFHRPLRSGKWAVTYEEWPEEAYPNYANGPGYVISADIARYIVSEFDNQTLRLFKMEDVNMGMWVEKFNNTLRPVEYRHDVRFYQSGCFDGYFTAHYQSPQHMICLWRKLQSGSSRCCNVR

SEQ ID NO: 7507 - protein, 594 aa, Zea mays
MAVEEAAESCGSHAAAAASGGGAAELATSSSSAAAAVQARKQQQQQRHKLEVYTEVLRRLHDAGLPDARAPGFDDELWNHFNRLPARYAMDVNVERAEDVLTHKRLLEQAKDPAQRPAFAVRAVQVSPILDGNQTDADSNTAGEEVASRLLNRQQSIHPPPAFGSSTNLEALALEASKSHQDHDSTSDNCRSLYRPMHEITFSTIDKPKLLSELTSLLGELGLNIQEAHAFSTNDGYSLDVFVVVGWHDEETEDLVEAVQKEIGRIEETQAWSSSHSWSTPVENMQIAEISAAGRVEIPTDGASEWEIDVKLLKFGNKVASGSYGDLYRGTYCSQDVAIKVLKPERINADMQREFAQEVYIMRKVRHKNVVQFIGASTKPPNLYIVTEFMSGGSVYDYLHKHKGVFKLPTLVGVAMDVSKGMSYLHQNNIIHRDLKTANLLMDENGTVKVADFGVARVKAQSGVMTAETGTYRWMAPEVIEHKPYDQKADVFSFGILMWELLTGKIPYEYLTPLQAAVGVVQKGLRPTIPKHTYAMLSELLQKCWQQDPAQRPDFSEILETLQRIAEEVGDEHEGKHKDRTLGGFFSALRGRSH

SEQ ID NO: 7508 - protein, 593 aa, Zea mays
MAVEETAESCGSHAATAASGGGAAGPATSSSSAAAAAQARKQQQQQRHKLEVYTEVLRRLHDAGLPDARAPGFDDELWNHFNRLPARYAMDVNVERAEDVLTHKRLLEQAKDPAHRPAFAVRSVQVSPILDGNQTDSDSNTAGEEVASRLLNRQQSIYPPPAFGSSTNLEALALEASKSHDHDSTSDNGRSLYRPMHEITFSTIDKPKLLSELTSLLGELGLNIQEAHAFSTNDGYSLDVFVVVGWHDEETEDLVEAVQKEIGRIEETQAWSSSHSWSTPVEKMQIAENSAADRVEIPTDGASEWEIDVKLLKFGNKVASGSYGDLYRGTYCSQDVAIKVLKPERINADMQREFAQEVYIMRKVRHKNVVQFIGACTKPPNLCIVTEFMSGGSVYDYLHKHKGVFKLPALVGVATDVSKGMSYLHQNNIIHRDLKTANLLMDENGTVKVADFGVARVKAQSGVMTAETGTYRWMAPEVIEHKPYDHKADVFSFGILMWELLTGKIPYEYLTPLQAAVGVVQKGLRPTIPKHTHAKLSELLQKCWQQDPTQRPDFSEILETLQRIAEEVGEEHDGKHKDRTLGGFFSALRGRSH

SEQ ID NO: 7509 - protein, 599 aa, Setaria italica
MAVEEAAESCGSHAAATAAAAASGGGAAGPATSSSSAAVAAQARKQQQQQRHKLEVYTEVLRRLHESGLPEARAPGFDDELWNHFNRLPARYAMDVNVERAEDVLTHRRLLEQARDPAQRPAFAVRAVQVSPILDGNQTDADSNTAGEEVASRLLNRQQSIHPPPAFGSSTNLEALALEVSKSQGQDHDSTSDNGRSLYRPMHEITFSTIDKPKLLSELTSLLGELGLNIQEAHAFSTNDGYSLDVFVVVGWHDEETEDLVEAVQKEIGRIEETQAWSSSHSWSTPVENMQIAENPAADRVEIPTDGSSEWEIDVKLLKFGNKVASGSYGDLYRGTYCSQDVAIKVLKPERINADMQREFAQEVYIMRKVRHKNVVQFIGACTKPPNLCIVTEYMSGGSVYDYLHKHKGVFKLPALVGVAMDVSKGMSYLHQNNIIHRDLKTANLLMDENGTVKVADFGVARVKAQSGVMTAETGTYRWMAPEVIEHKPYDHKADVFSFGILLWELLTGKIPYEYLTPLQAAVGVVQKGLRPTIPKHTHAKLCELLQKCWQQDPAQRPDFSEILETLQRISEEVGDEHEGKHKDKLLGGFFSALRGRGH

SEQ ID NO: 7510 - protein, 579 aa, Panicum virgatum
AASGGGAAGPATSSSSAAAAAQARKQQQQQRHKLEVYTEVLRRLHESGLPEARAPGFDDELWNHFNRLPARYAMDVNVERAEDVLTHRRLLEQARDPAQRPAFAVRAVQVSPILDGNQTDADSNTAGEEVASRLLNRQQSIHPPPAFGSSTNLEALALEVSKSQGQDQDSTSDNGRSLYRPMHEITFSTIDRPKLLSELTSLLGELGLNIQEAHAFSTNDGYSLDVFVVVGWHDEETEDLVEAVQKEIGRIEETQAWSSSHSWSTPVENMQVAENSAADRVEIPTDGASEWETDVKLLKFGNKVASGSYGDLYRGTYCSQDVAIKVLKPERINADMQREFAQEVFIMRKVRHKNVVQFIGACTKPPNLCIVTEYMSGGSVYDYLHKHKGVFKLPALIGVAMDVSKGMSYLHQNNIIHRDLKTANLLIDENGTVKVADFGVARVKAQSGVMTAETGTYRWMAPEVIEHKPYDHKADVFSFGILLWELLTGKIPYEYLTPLQAAVGVVQKGLRPTIPKHTHAKLSELLQKCWQQDPALRPDFSEVLETLQRIAEEVGDEHEGKHKDKILGGFFSALRGRGH

SEQ ID NO: 7511 - protein, 556 aa, Saccharum officinarum
RARKQQQQQRHKFEVYTEVLRRLHDAGLPDARAPGFDDELWSHFNRLPARYAMDVNVERAEDVLTHKRLLEQAKDPAQRPAFAVRAVQVSPILDGNQTDADSNTAGEEVASRPLNRQQSIHPPPAFGSTNLEALALEASKSHQDHDSTSDNGRSLYRPMHEITFSTIDKPKLLSELTSLLGELGLNIQEAHAFSTNDGYSLDVFVVVGWHDEETEDLEEAVQKEIGRIEETQAWSSSHSWSTPVENMQIAENSAADRVEIPTDGASEWEIDVKLLKYGNKVASGSYGDLYRGTYCSQDVAIKVLKPERINADMQREFAQEVYIMRKVRHKNVVQFIGASTKPPNLCIVTEFMSGGSVYDYLHKHKGVFKLPALVGVAMDVSKGMNYLHQNNIIHRDLKTANLLMDENGTVKVADFGVARVKAQSGVMTAETGTYRWMAPEVIEHKPYDHKADVFSFGILMWELLTGKIPYEYLTPLQAAVGVVQKGLRPTVPKHTHARLSELLQKCWQQDPAQRPDFSEILETLQRIAEEVGDEHEGKHKDRTLGGFFSALRGRSH

SEQ ID NO: 7512 - protein, 592 aa, Brachypodium distachyon
MAVEEAAESCGSHAAAAASRGGAGSSSPPAASGAQSRKHQQQQRHKLEVYTEVLRRLHDAGIPEEQSPGFEDELWSHFNRLPARYAMDVNVERAEDVLTHKRLLEQAKDPAQRPAFAVRAVQVSPILDGNQTDADSNTAGEEVASRLLNRQQSIHPPPAFGSSTNLEALALEASKSQGQDHDSTSDNVRSLYRPMHEITFSTIDKPKLLSELTCLLGELGLNIQEAHAFSTNDGYSLDVFVVVGWHAEETEDLVEEVKKEISKIEETQAWSSSHSWSSPVDNMQIVENSAPDHVEIPTDGASEWEIDVKLLNFGNKVASGSYGDLYRGTYCSQDVAIKVLKPERVNADMQREFAQEVYIMRKVRHKNVVQFIGACTKPPRLCIVTEYMSGGSVYDYLHKHKGVFKLPALVGVAIDVSKGMSYLHQNNIIHRDLKTANLLMDENGMVKVADFGVARVKVQSGVMTAETGTYRWMAPEVIEHKPYDHKADVFSFGILMWELLTGKIPYEYLTPLQAAVGVVQKGLRPTVPKNAHAKLGELLQKCWQQDPTQRPDFSEILETLQRIAEEVGDEHEGKHKDKTLGGFFSALRGRGH

SEQ ID NO: 7513 - protein, 603 aa, Oryza sativa
MAVEEAAESCGSHAAASAAGRRGGGGGGGGGATSSSSSASAGAAAAAAARKQQQQQRHKLEVYTEVLRRLHDSGVPEARREGFDDELWNHFNRLPARYAMDVNVERAEDVLTHKRLLEQAKDPAQRPAFAVRAVQVSPILDGNQTDADSNTAGEEVASRLLNRQQSIHPPPAFGSSTNLEALALEASKSQGQDHDSTSDNVNYRPMHEITFSTIDKPKLLSELTSLLGELGLNIQEAHAFSTNDGYSLDVFVVVGWHDEETEDLIESVRKEIGKIDETQGWSTTHSWSSPVENMQIGENSAADHVEIPRDGASEWEIDVKLLKFGNKVASGSYGDLYRGTYCSQDVAIKVLKPERINADMQREFAQEVYIMRKVRHKNVVQFIGACTKPPNLCIVTEYMSGGSVYDYLHKHKGVFKLPALLGVVMDVSKGMSYLHQNNIIHRDLKTANLLMDENGTVKVADFGVARVKAQSGVMTAETGTYRWMAPEVIEHKPYDHKADVFSFGILMWELLTGKIPYEYLTPLQAAVGVVQKGLRPTIPKNAHAKLSELLQKCWQQEPAERPDFSEILETLQRIAEEVGDEHDGKHKEKILGGLFSALRGRGH

SEQ ID NO: 7514 - protein, 598 aa, Hordeum vulgare
MAVEEVAESCGSHAAAAGGGGGGGGAGSSSPPGAAGSGSVAGAQSRKQQQQHHHKLEVYTEVLARLHAAEERAPGFDDELWSHFNRLPARYAMDVNVERAEDVLTHKRLLELARDPAQRPAFAVRAVQVSPILDGNQTDADSHTAGEEVASRLLNRQQSIHPPPAFGSSTNLDALALEASKSQGQDQDSTSDNVRSLYRPMHEITFSTIDKPKLLSELTCLLGEIGLNIQEAHAFSTNDGYSLDVFVVVGWHAEETVDLIEELKKEIIKIEETQAWSTSHSWSSPVENMQIVENSTADHVAIPTDGASEWEIDIKLLNFGNKVASGSYGDLFRGTYCSQDVAIKVLKPERVNVDMQREFAQEVYIMRKVRHKNVVQFIGACTKPPRLCIVTEFMSGGSVYDYLHKHKGIFKLPALVGVAMDVSKGMSYLHQNNIIHRDLKTANLLMDENGMVKVADFGVARVKVQSGVMTAETGTYRWMAPEVIEHKPYDHKADVFSFGILLWELLTGKIPYEYLTPLQAAVGVVQKGLRPTIPKNAHAKLTELLQKCWQQDPAERPDFSEILEALKKIAEEVGDEHDGKHKDKSLGGFFSSLRGRGH

SEQ ID NO: 7515 - protein, 136 aa, Secale cereale
MAVEEVAESCGSHAAAAGGGGGGGGGGGGGKAGSSSPPGGAGAQSRKQQQQHHHKLEVYTEVLARLHAAEERAPGFDDELWSHFNRLPARYAMDVNVERAEDVLTHKRLLELAKDPAQRPAFAVRAVQGRKLRQGC

SEQ ID NO: 7516 - protein, 310 aa, Secale cereale
MQIVENSTADHVAIPTDGASEWEIDIKLLNFGNKVASGSYGDLFRGTYCSQDVAIKVLKPERVNVDMQREFAQEVYIMRKVRHKNVVQFIGACTKPPRLCIVTEFMSGGSVYDYLHKHKGIFKLPALVGVAMDVSKGMSYLHQNNIIHRDLKTANLLMDENGMVKVADFGVARVKVQSGVMTAETGTYRWMAPEVIEHKPYDHKADVFSFGILLWELLTGKIPYEYLTPLQAAVGVVQKGLRPTIPKNAHGKLTELLQKCWQQDPAERPDFSEILEALKKIAEEVGDEHDGKHKDKSLGGFFSSLRGRGH

SEQ ID NO: 7517 - protein, 541 aa, Triticum aestivum
YTEVLAGPPPAPRSAPPAWTTTLWSHFNRLPARYAMDVNVERAEDVLTHKRLLELAKDPAQRPAFAVRAVQVSPIVDGNQTDADSHTAGEEVASRLLNRQQSIHPPPAFGSSTNLEALALEASKSQGQDQDSTSDNVRSLYRPMHEITFSTIDKPKLLSELTCLLGEIGLNIQEAHAFSTNDGYSLDVFVVVGWHAEETEDLIEELKKEISKIEETQAWSTSHSWSSPVENMQIVENSTADHVAIPTDGASEWEIDIKLLNFGNKVASGSYGDLYRGTYCSQDVAIKVLKPERVNVDMQREFAQEVYIMRKVRHKNVVQFIGACTKPPRLCIVTEFMSGGSVYDYLHKHKGIFKLPALVGVAMDVSKGMSYLHQNNIIHRDLKTANLLMDENGMVKVADFGVARVKVQSGVMTAETGTYRWMAPEVIEHKPYDHKADVFSFGILLWELLTGKIPYEYLTPLQAAVGVVQKGLRPTIPKNAHAKLAELLQKCWQQDPAERPDFSEILEALKKIAEEVGDEHDGKHKDKSLGGFFSSLRGRGH

SEQ ID NO: 7518 - protein, 780 aa, Oryza sativa
MDSSRDSEEERPQRKDNGEETENGEDGGNALSLKDVANELLGCVVHSEEEAYKLYCDYGHRIGFSVRKGKQSYFIGTKNIRTKDYYCSKEGLKYDEPVTEANFNRPDTRTNCKAMIRFRVDEKGRWTVIRFVPTHNHQLAKPGERHMLRSAKSLAVGKSGVIDPQASTESHPINGFSHMIGSDIVEPPGYTIRDCYNHVSMQGITIIEAGDSQSLVNYFKRRTNEEGMFYWDVQVDQEGRMTNFFFRDAKSRNDFDCFGDAVIFDTTFRTNKYSLVCAPFVGVNHHWQNIVFGCAFLLDESSASYVWLFKSFLESMGGRSPKSIFTDQDDAITQAVELVFPNTQHCFSYWHILKNAQSHLGTVNTSQTFQNMFIKCMQGPNSETELEESWATMLNEYKLQENSWLSDLYRSRNKWCSAFNKDTFDGGINSSQWGEVSNNTFTGISDESTPLTRFALLLEKVFKGLRRNESEEDFRCSQTAPVRAIKHSTVLKQAAESYTHKIYKLFEAEFLDGCGATSCHESSCGGNLLRFEITMQGRGSKVWTVLLDTSTMEISCGCRKFERMGLLCSHALKAFSLQNVDTIPEKYISKRWTKDARRSMYKLSQDDSTQQECTEAELAYRNRATQYACSLIAKSQELDESRKIFWDTLETGEKALDVFFEIRSLRSQAAKDVSKRDKKKKKSSKGPSTKKAKPTPATSSAVPELLAQTNVHQFQSAQDAQGNTTIGRPLYYQAFSSAPIQPNQIYMHPNMHTMPLCAPQDFSAYSAMRPNSNFGGAKNV

SEQ ID NO: 7519 - protein, 437 aa, Zea mays
MPPATGAVADTAPAAGTVLLGRYELGGLLGRGASAKVYLARDLLTGRSVAIKSFPNPRAGGGAGVGVNAAIEREACILRRLRHRHVVRLHEILATRKKVHFVLDLAGGGELFSLVDASGRMTEDLARHYFRQLVSAVRYCHARGVYHRDIKPENLLLDEGGALKVADFGLGAVGGGGGGGGGEGLRHTMCGTPAYVAPEILSRKGYEPGKVDIWSCGVVLFVLAAGYLPFNDASLVNMYRKIYAGRFRCPGWFSPALRDLLRRVLDPDPSARIDADGIVAHPWFRHGGEEDLGGLVHGGYEEVEEEEEEAKADEDREPTAFDILSFSPGSDLSALFVGAGGGGKERVFVGEPAAAVLGRVEAAARKGGYRARRDGKRATVYVEEEEEEGGGGVLAKVSVFRLADAVSVVEVVKGDGADAALVWTELLEPAVKPPALS

SEQ ID NO: 7520 - protein, 430 aa, Zea mays
MPPATGAVASAAGTVLLGRYELGGLLGRGASAKVYLARDLRTGRSVAIKSFPNPRAASDRPVAIEREAGILRRLRHRHVVRLHEILATRTKVHFVLDLAAGGELLSLVDASGRMTEDLARHYFRQLVCAVRYCHARGVCHRDIKPENLLLDGAGALKVADFGLGAVAGAGGDLLRHTTCGTPAYVAPEILSRKGYEYDPAKVDIWSCGVVLFVLAAGYLPFNDASLVNMYRKIYAGRFRCPAWFSPALRDLLRRVLHPDPSARADADSIVAHPWFRHGASDEEMGRLMHGGGGDEDEEAWVGAAADEDDAGREPTAFDILSFSPGCDLSALFLGGGCKERVFVGEAAAGVLGRVEAAGRKGGYRVRKEGKRGVRVEGEEGGVVAKVSVVRLADAVSVVEVVKDDGADAALFWTELLEPAVCVPATALCHV

SEQ ID NO: 7521 - protein, 432 aa, Setaria italica
MSPATGAVASAAPGEESPAGTVLLGRYELGGLLGRGASAKVYLARDLLTGESVAIKSFPNPRASGGAEEGRRPAAIEREAAILRRLRHRHVVRLHEILATRKKVHFVLDLAAGGELFSLVDASGRMTEDLARHYFRQLISAVRYCHARGVFHRDIKPENLLLDEAGALKVADFGLGAVADGGNLRHTLCGTPAYVAPEILSRKGYDPAKVDIWSCGVVLFVLAAGYLPFNDASLVNMYRKIYAGKFRCPSWFSPALRDLLRRVLHPNPDARIDADGIVAHPWFCDGASDEELARLMVGGHEEAWFKPEFKEDMAREMTAFDILSFSPGSDLSALFGAGPGKERVFVSEPAADVLSRVEAAGRKEGYRVRREGKRGTGPVYLEEESGGIVAKVSVFKLADAVCVVEVVKGDGAEAALFWTERLQPAVKPPVLS

SEQ ID NO: 7522 - protein, 318 aa, Panicum virgatum
MSPATGAVASAAAGEESPAAAATVLLGRYELGDLLGRGASAKVYRARDLLTGRSVAIKSFPNPRAAGAEKGRRPVAIEREAAILRRLRHRHVVRLHEILATRKKVHFVLDLAAGGELFSLVDASGRMTEDLARHYFRQLISAVRYCHARGVFHRDIKPENLLLDEAGELKVADFGLGAVADDATSATRSAAPRRTWRRRSCRGKGTTQPRWTSGPAAWSCSCSPPATSPSTTPASSTCTARSTRAGSGARAGSRRRCATCCAAFWTRTRTPASTRTTSWATRGSATAPATRSWPASCAATRRSPGSSPSSRRRTWRGR

SEQ ID NO: 7523 - protein, 429 aa, Zea mays
MATAARERRLPPALPLATLIGRELRAGGSERPALRYGHAGFAKRGEDYFLVKPDCLRVPGDPASAFSVFAVFDGHNGVSAAVYSKEHLLEHVMSALSPDIGREDWLQALPRALVAGFVKADIDFQRKGEVSGTTATLVVIDGFTVTVASVGDSRCILDTQGGELQLLTVDHRLEENAEERERVTASGGEVGRLNLFGGQEVGPLRCWPGGLCLSRSIGDMDVGEFIVPIPHVKQVKLSNTGGRLIIASDGIWDALSNEAAAKACRGLPAELAAKLVVKQALKTSGLKDDTTCVVVDIIPSDHLTSPQLSPKKNQNKLKSLFRRRSHSSVRKLGGKSASIGSVEELFEEGSAMLEERLGRNLSLKAASPPFRCAICQVDQEPFQDLMADNGGGYCSSQYAPWGGPCLCLDCRKKKDAMEGKRCSRSTACR

SEQ ID NO: 7524 - protein, 432 aa, Panicum virgatum
MATAARVRETRLPPPPLPLATLIGRELRAGGSERPALRYGHAGFAKRGEDYFLVKPDCLRVPGDPSSAFSVFAVFDGHNGVSAAVYSKEHLLEHVISALPPDIGRDDWLQALPRALVAGFVKADIDFQRKGEVSGTTATLVVIDGFTVTVASVGDSRCILDTQGGELQLLTVDHRLEENAEERERVTASGGEVGRLNLFGGQEVGPLRCWPGGLCLSRSIGDMDVGEFIVPIPHVKQVKLSNVGGRLIIASDGIWDALSNEAAAKACRGLPAELAAKLVVKQALKTSGLKDDTTCVVVDIIPSDHLTSPQLSPKKNQNKLKSLFRRRSHSSVGKLGGKSASFGSVEELFEEGSAMLEERLGRNLSLKAASPPFRCAICQVDQEPFEGLMTDNGGGYCSSPYAPWGGPHLCLECRKKKDAMEGKRSSRSTACR

SEQ ID NO: 7525 - protein, 431 aa, Pennisetum glaucum
MATAAREARLLPPPLPLATLIGRELRAGGSERPTLRYGHAGFAKRGEDYFLVKPDCLRVPGDPSSAFSVFAVFDGHNGVSAAVYSKEHLLEHVISALPPDIGREDWLQALPRALVAGFVKADIDFQRKGEVSGTTATLVVIDGFTVTVASVGDSRCILDTQGGELQLLTVDHRLEENAEERERVTASGGEVGRLNLFGGQEVGPLRCWPGGLCLSRSIGDMDVGEFIVPIPHVKQVKLSNAGGRLIIASDGIWDALSNEAAAKACRGLPAELAAKLVVKQALKTSGLKDDTTCVVVDIIPSDHLTSPQLSPKKNQNKLKSLFRRRSHSSVGKLGGKSASIGSVEELFEEGSAMLEERLGRNLSMKAAASPPFRCAICQVDQEPFEGLLTDNGGGYCSSPYAPWGGPHLCLDCRKKKDAMEGKRSSHSTACR

SEQ ID NO: 7526 - protein, 430 aa, Setaria italica
MATAARETRLLPPPLPLATLIGRELRAAGSERPTLRYGHAGFAKRGEDYFLVKPDCLRVPGDPSSAFSVFAVFDGHNGVSAAVYSKEHLLEHVISALPPDIGRDDWLQALPRALVAGFVKADIDFQRKGEVSGTTATLVVIDGFTVTVASVGDSRCILDTQGGELQLLTVDHRLEENAEERERVTASGGEVGRLNLFGGQEVGPLRCWPGGLCLSRSIGDTDVGEFIVPIPHVKQVKLSNAGGRLIIASDGIWDALSNEAAAKACRGLPAELAAKLVVKQALKTSGLKDDTTCVVVDIIPSDHLTSPQLSPKKNQNKLKSLFRRRSHSSVGKLGGKSASIGSVEELFEEGSAMLEERLGRNLSLKAASPPFRCAICQVDQEPFEGLMTDNGDGYCSSPYAPWGGPHLCLDCRKKKDAMEGKRSSRSTACR

SEQ ID NO: 7527 - protein, 429 aa, Zea mays
MTTAARERRLPPTLPLATLIGRELRAGGSERPALRYGHAGFAKRGEDYFLVKPDCVRVPGDPASAFSVFAVFDGHNGVSAAVYSKEHLLEHVMSALPPDIGRDDWLQALPRALVAGFVKADIDFQRKGEVSGTTATLVVIDGFTVTVASVGDSRCILDTQGGELQLLTVDHRLEENAEERERVTASGGEVGRLNLFGGQEVGPLRCWPGGLCLSRSIGDMDVGEYIVPIPHVKQVKLSNAGGRLIIASDGIWDALSNEAAAKACRGLPAELAAKLVVKQALKTSGLKDDTTCVVVDIIPSDHLTSPQLSPKKNHNKLKSLFRRRSHSSVGKLGGKSASIGSVEELFEEGSAMLEERLGRNLSLKAVSAPFRCAICQVDQEPFEDLMRDNGGGYCSSPCAPWGGPYLCLDCRKKKDAMEGKRSSCSTACR

SEQ ID NO: 7528 - protein, 433 aa, Hordeum vulgare
MAGAERERRKLPPALPLATLIGRELRAGGSERPALRYGHAGFAKRGEDYFLVKPDCLRVPGDPSTAFSVFAVFDGHNGVSAAVFSKEHLLEHVMSALPPDIGGREEWLQALPRALVAGFVKADIDFQRKGEVSGTTATLVVVDGFTVTVASVGDSRCILDTQGGELQLLTVDHRLEENVEERERVTASGGEVGRLNLFGGQEVGPLRCWPGGLCLSRSIGDMDVGEYIVPVPHVKQVKLSSVGGRLIMASDGIWDALSNEAAAQSCRGLPAELAAKLVVKQALKKCGLKDDTTCVVVDIIPSDHRLTSPQLSPKRNQNKLKSLLFRRRSHSSVGKFGGKSASIGSVEELFEEGSAMLEERLGRNLSLKAASPPSRCAICQVDQEPFEGLMEENGGSHCSSPYAPWGGPYLCLECRKKKDAMEGKRPSCSTACR

SEQ ID NO: 7529 - protein, 435 aa, Unknown
  Sequence found in Organisms: Secale cereale, Triticum aestivum
MAGAERERRKMPLPPALPLATLIGRELRAGGSERPALRYGHAGFAKRGEDYFLVKPDCLRVPGDPSTAFSVFAVFDGHNGVSAAVFSKEHLLEHVMSALPPDIGSREDWLQALPRALVAGFVKADIDFQRKGEVSGTTATLVVVDGFTVTVASVGDSRCILDTQGGELQLLTVDHRLEENVEERERVTASGGEVGRLNLFGGQEVGPLRCWPGGLCLSRSIGDMDVGEYIVPVPHVKQVKLSSVGGRLIMASDGIWDALSNEAAAKSCRGLPAELAAKLVVKQALKKCGLKDDTTCVVVDIIPSDHHLTSPQLSPKRNQNKLKSLLFRRRSHSSVGKFGGKSASIGSVEELFEEGSAMLEERLGRNLSLKAASPPSRCAICQVDQEPFEGLMEENGGSHCSSPYAPWGGPYLCLECRKKKDAMEGKRPSCSTACR

SEQ ID NO: 7530 - protein, 431 aa, Oryza sativa
MAGIAKERRLPPALPLATLIGRELRAGGSERPSLRYGHAGFAKRGEDYFLVKPDCLRVPGDTSTAFSVFAVFDGHNGVSAAVYSKEHLLEHVMSALPPDIGRDDWLQALPRALVAGFVKADIDFQRKGEVSGTTATLVVVDGFTVTVASVGDSRCILDTQGGEVQLLTVDHRLEENAEERERVTASGGEVGRLNLFGGQEVGPLRCWPGGLCLSRSIGDMDVGEFIVPIPHVKQVKLSNIGGRLIIASDGIWDALPSEAAAKACRGLPAELAAKLVVKQALKKSGLKDDTTCVVVDIIPSDYRLTSPQLSPKRNQSKFKSLLFGRRSHSSIGKLGGKSASFGSVEELFEEGSAMLEERLGRNLSLKATSAPLRCAICQVDQEPFESMMTEKGGSYCSSPCAPWGGPYLCLECRKKKDAMEGKRSSHSTACR

SEQ ID NO: 7531 - protein, 432 aa, Brachypodium distachyon
MAGAEREKARLPPALPLATLIGRELRAGGSERPALRYGHAGFAKRGEDYFLVKPDCLRVPGDPSTAFSVFAVFDGHNGVSAAVFSKEHLLEHVMSALPPDIGGREEWLQALPRALVAGFVKADIEFQRKGEVSGTTATLVVVDGFTVTVASVGDSRCILDTQGGELQLLTVDHRLEENVEERERVTASGGEVGRLNLFGGQEVGPLRCWPGGLCLSRSIGDMDVGEYIVPVPHVKQVKLSNVGGRLIIASDGIWDTLSNEAAAKSCRGLPAELAAKLVVKQALKKCGLKDDTTCVVVDIIPSDRLVSPQLSPKRNQNKLKSLLFGRRSHSSVGKFGGKSASFGSVEELFEEGSAMLEERLGRNLSLKAASPPSRCAICQADQEPFEGLMAENGGSHCSSPYTPWGGPYLCLECRKKKDAMEGKRSSCSTACR

SEQ ID NO: 7532 - protein, 430 aa, Setaria italica
MAGAATEGKLSPALPLATLIGRELRGDGSERPLVRYGHSGFAKRGEDYFLVKPDCLRVPGDPSSAFSVFAVFDGHNGVSAAVFSKEKLLEHVMSAVPQGISREDWLQALPRALVAGFVKTDIDFQRKGETSGTTATLVVVDGFTVTVASVGDSRCILDTQGGEVSLLTVDHRLEENAEERERVTASGGEVSRLNLCGGQEVGPLRCWPGGLCLSRSIGDTDVGEFIVPIPHVKQVKLPNTGGRLIIASDGIWDALSSETAAQACRGLPAELAAKLVVKQALKTSGLKDDTTCVVVDIIPSDHCSTPPALSPKRNQNMLKSLIFGRRSHSSVGKLSKSASLSSVEEIFEEGSAMLEERLGRNFPSKANLPPFRCAICQVDQEPFEGLMTDNVGGCCSAPSTPWGGPYLCSDCRKKKDAMEGKRSSRSTTCR

SEQ ID NO: 7533 - protein, 432 aa, Oryza sativa
MESAAGEEGKAAPSLPLATLIGRELRGGGSERPLVRYGHFGFAKRGEDYFLVKPDCLRVPGDPSSAFSVFAVFDGHNGVSAAVFSKEHLLEHVMSAVPQGIGRDDWLQALPRALVAGFVKTDIDFQRKGEASGTTATLVVVDGFTVTVASVGDSRCILDTQGGVISLLTVDHRLEENVEERERVTASGGEVSRLNLCGGQEVGPLRCWPGGLCLSRSIGDTDVGEFIVPIPHVKQVKLSNAGGRLIIASDGIWDALSSEAAAQACRGLPAELAAKLVVKQALKTSGLKDDTTCVVVDIIPSDHSSTPPSLSPKKNQNKLRSLLFGRRSHSSVGKLGNKSASFDSVEELFEEGSAMLDERLGRNFPSKANSSPSRCAICQVDQAPFEDLVTDNGGGCCSAPSTPWVGPYLCSDCRKKKDAMEGKRSSRSTACR

SEQ ID NO: 7534 - protein, 431 aa, Sorghum bicolor
MAALAASEGNLSPTLPLATLIGRELRGDGTERPHVRYGHSGFAKRGEDYFLVKPDCLRVPGDPSSSFSVFAVFDGHNGVSAAVFSKEKLLEHVMSAVPQGISREDWLQALPRALVAGFVKTDIDFQRKGETSGTTATLVVVDGFTVTVASVGDSRCILDTHGGEVSLLTVDHRLEENAEERERVTASGGEVSRLNLCGGQEVGPLRCWPGGLCLSRSIGDTDVGEFIVPIPHVKQVKLPNTGGRLIIASDGIWDALSSEIAAQACRGLPAELAAKLVVKQALKTSGLKDDTTCVVVDIIPSDHCSTPPALSPKKNQNKLRSLIFGRRSHSSVGKLTKSASLGSVEEIFEEGSAMLEERLGRNFPSKANLPPFRCAICQVDQEPFEGLMTDNVGGCCSAPSTPWGGPYLCSDCRKKKDAMEGKRSNRSATCR

SEQ ID NO: 7535 - protein, 433 aa, Brachypodium distachyon
MESASREERLPPALPLATLIGRELRGGGSERPLVRYGHSGFAKRGEDYFLVKPDCFRVPGDPSSAFSVFAVFDGHNGVSAAVFSKEHLLEDVMSAVPQGISREDWLQVLPRALVAGFVKTDIDFQRKGEMSGTTATLVVVDGFTVTVASVGDSRCILDTQGGVVSLLTVDHRLEENAEERERVTASGGEVSRLNLCGGQQVGPLRCWPGGLCLSRSIGDTDVGEFIVPIPHVKQVKLSNAGGRLIIASDGIWDAVSSETAAQACRGLPAELAAKLVVKQALKTSGLKDDTTCVVVDIIPSDHCSTPPPLSPNKNQNKLRSLLFGRRSHSSVGKLGNRKKSASFGFVEELFEEGSAKLEERLGRNSPSKAKFPPFRCAICQVDQVPFEDLMTDNGGGYCSAPSTPSAGPYLCSDCKKKKDAMEGKRSSPSTVCS

SEQ ID NO: 7536 - protein, 345 aa, Secale cereale
MESASNEEMLPPALPLATLIGRELRGGGSERPLVRYGHSGFAKRGEDYFLVKPDCLRVPGDPSSAFSVFAVFDGHNGVSAAVFSKEHLLDDVMSAVPQGINREDWLQVLPRALVAGFVKTDIDFQRKGEMSGTTATLVVIDGFTVTVASVGDSRCILDTQGGVVSLLTVDHRLEENAEERERVKASGGEVSRLNLCGGQQVGPLRCWPGGLCLSRSIGDTDVGEFIVPIPHVKQVKLSSAGGRLIIASDGIWDAVSSEIAAQACRGLPAELAAKLVVKQALKTTGLKDDTTCVVVDIIPSDHCSTPPPLSPKQNHNKLRSLLFGRRSHSSVGKLGKKKSLLHLDL

SEQ ID NO: 7537 - protein, 776 aa, Brachypodium distachyon
MGSNLREILDNVSYPEIFLSFPNAKEKKRIESKEKAILEFYQQFACVGGDLVFSESLCEELQKKFFQQKCELGRIGRRNMNRRLNLDIPQNNTFLLPRDVLAATDQLIGMKFGTGILDDDDMNHLKNKRIRSVADLLQDQFGLALGRLQHAVQKTIRRVFIRQSKPTPHTLVTPTSTSILLITTYETFFGAYPLSQVFDQTNPLTQTVHGRKVSCLGPGGLTGRTASFRSRDIHPSHYGRICPIDTSEGINVGLTGSLAIHAKIDHLWGSVESPFYEISAEKAKEKKERQVVYLSPNRDEYYMIAAGNSLSLNQGIQEEQVVPARYRQEFLTIVWEQIHVRSIFPFQYFSIGGSLIPFIEHNDANRALMSSNMQRQAVPLSRSEKCIVGTGLERQTALDSRVSVIAEREGKIISTDSHRILLSSSGKTISIPLVNHRRSNKNTCMHQKPRVPRGKSIKKGQILAEGAATVGGELALGKNVLVAYMPWEGYNFEDAVLISERLVYEDIYTSFHIRKYEIQTDTTSQGSAEKITKEIPHLEEHLLRNLDRNGVVRLGSWVETGDILVGKLTPQIASESSYIAEAGLLRAIFGLEVSTSKETSLKLPIGGRGRVIDVKWIQRDPLDIMVRVYILQKREIKVGDKVAGRHGNKGIISKILTRQDMPYLQDGTPVDVVFNPLGVPSRMNVGQIFESSLGLAGDLLKKHYRIAPFDERYEQEASRKLVFSELYEASKETKNPWVFEPEYPGNSRIFDGSTGDPFEQPVLIGKSYIIKINSSS

SEQ ID NO: 7538 - protein, 1279 aa, Cajanus cajan
MNPNFRMTDPFNPVHIMSFSGARGNASQVHQLVGMRGLMSDPQGQMIDLPIQSNLREGLSLTEYIISCYGARKGVVDTAVRTSDAGYLTRRLVEVVQHIVVRRTDCGTIRGISVSPRNRRMPERILIQTLIGRVLADDIYIGSRCIAIQNQDLGIGLVNRFITFQTQPISIRTPFTCRSTSWICRLCYGRSPTHGDLVELGEAVGIIAGQSIGEPGTQLTLRTFHTGGVFTGGTAEHVRAPSNGKIKFNEDLVHPTRTRHGHPAFLCYIDLYVTIESEDIIHNVTIPPKSFLLVQNNQYVESEQVIAEIRAGTYTLNFKERVRKHIYSASEGEMHWSTDVYHAPEFTYSNVHILPKTSHLWILSGRSCRSGAISFSLHKDQDQMSIHSLSAGGRYISNLVVSNDQVQVRHKFFSSNPSGKKKSGIPDYSGLNRIICIGHFNFIYSAILHDNSDLLAKRRRNRFIIPFQSIQERDKELMPPSGISIEIPINGIFRRNSILAYFDDPQYRKKSSGITKYRTIGVDSIFKKEDLIEYRGVKELKPKYQMKVDRFFFIPEEVHILPESSSIMVQNNSIIGVDTPITVNIRSRVGGLVRVEKKKKGIELKIFSGDIYFPGEMDKISRHSGILIPLGTVKKKNSMESKKFKNWIYVQWITPTKKKYFVLVRPVIIYEIADGINLVKLFPHDLLQERDNLELKVVNYILYGNGKQIQGISDTSIQLVRTCLVLNWDRDKKSSSIEETRASFVEVSTNGLIRDFLRMDLVKSHISYIRKRNDLSGSRLIADNESDRTKINPFFSIYSKAKIQQPLSQNHGTIRMLLNRNKKCRSFIILSSSNCFQIRSFNDVKYYNGIKEEINQIQRDLIIPIHNSLGPLGLTFQVAKFYSFYRLITHNQISITKYLQLDNLKETFQVFKYYLIDENGRIYKPDLCRNIVLNPFHFNWYFLHHNYQHNYCEKTFTIINLGQFLCENVCIAKNGQHLKSGQVLIVQIDSVVIRSANPYLATPGATVHGHYGEILSEGDILVTFIYEKSRSGDITQGLPKVEQVLEVRSIDSISMNLEKRVEGWNERITKILGIPWGFLIGAELTIVQSRISLVNKIQKVYRSQGVQIHNRHIEIIVRQITSKVLVSEDGMSNVFSPGELIGLLRAERTGRALDEAICYRALLLGITKTSLNTQSFISEASFQETARVLAKAALRGRIDWLKGLKENVVLGGTIPVGTGFKRLMRRSRPRQHKKITLEKKKLEGEMRDILFHHRELFDFFISKNLCDTSEQSFRGFNHS

SEQ ID NO: 7539 - protein, 593 aa, Zea mays
MAGSVEGENGGVPVGGQVAMAPGVVTGGVEDAYGEDRATEDQTVTPWAVCIASGHSLLRDPRHNKGLSFTEKERDTHYLRGLLPPVVLSQDLQEKRMLQNVRQFQVPLQRYTALMDLQERNERLFYKLLIDNVEELLPVVYTPTVGEACQKYGSIFRRPQGLYISLKEKGRILEVLRNWTEKSIQVIVVTDGERILGLGDLGCQGMGIPVGKLALYTALGGVRPSACLPITIDVGTNNEDLLKDEFYIGLKQRRATGQEYSEFLDEFMAAVRQNYGQKVLVQFEDFANHNAFTLLEKYRTNHLVFNDDIQGTAAVVLAGIIAALKSVGGTLADHTFLFFGAGEAGTGIAELVALEISRQANVSVEEARKKIWLVDSKGLIVASREETLQPFKKRYAHEHEPVKDLLGAVKAIRPTALIGSAGVGQSFTKEVIEVMSSINERPIVLALSNPTSQSECTAEQAYTWSQGRAIFGSGSPFDPVKYNDKLFVPAQANNAYIFPGFGLGVVISGAVRVSDDMVLAAAEALAEQVTPEHIEKGLIYPPFSIIRKISANIAAHVAAKAYDLGMATQLPRPKDLVKYAESCMYSPVYRSYR

SEQ ID NO: 7540 - protein, 575 aa, Pennisetum glaucum
ELNNGVVTGGVEDAYGEDRATEDQPVTPWAVCIASGHSLLRDPRHNKGLSFTEKERDAHYLRGLLPPVVLSQDLQEKRMLQNVRQLEVPLQRYMALMDLQERNERLFYKLLIDNVEELLPVVYTPTVGEACQKYGSIFRRPQGLYISLKEKGRILEILRNWPEKSIQVIVVTDGERILGLGDLGCQGMGIPVGKLALYTALGGVRPSACLPITIDVGTNNEDLLKDEFYIGLKQRRATGQEYSELLDEFMTAVRQNYGQKVLVQFEDFANHNAFTLLEKYRENHLVFNDDIQGTAAVVLGGLIAALKSVGGTLADHTFLFFGAGEAGTGIAELVALEISRQAKVSVEEARKKIWLVDSKGLVVTSRNETLQPFKKRYAHEHEPVKDLLGAVKAIKPTALIGSAGVGQSFTKEVIEAMSSINERPIILALSNPTSQSECTAEQAYTWSQGRAIFGSGSPFDPVKYNDKLFVPAQANNAYIFPGFGLGVVISGAVRVTDDMVLAAAEGLADQVTPEHIDKGLIYPPFSIIRKISANIAARVAAKAYDLGLASQLPRPKDLVKYAESCMYTPVYRSYR

SEQ ID NO: 7541 - protein, 582 aa, Panicum virgatum
MAASGEGDNRNGVVTGGVEDAYGEDRATEDQPVTPWAVCVASGHSLLRDPRHNKGLSFTEKERDAHYLRGLLPPVVLSQDLQEKRLLQNVRQFEVPLQRYMALMDLQERNERLFYKLLIDNVEELLPVVYTPTVGEACQKYGSIFRRPQGLYISLKEKGRILEVLRNWPEKSIQVIVVTDGERILGLGDLGCQGMGIPVGKLALYTALGGVRPSACLPITIDVGTNNEDLLKDEFYIGLKQRRATGQEYYELLDEFMTAVRQNYGQKVLVQFEDFANHNAFTLLEKYRANHLVFNDDIQGTAAVVLAGLIAALKSVGGTLADHKFLFFGAGEAGTGIAELVALEISRQGKVSVEEARQKIWLVDSKGLVVASRNEILQPFKKRYAHEHEPVKDLLDAVKAIRPTALIGSAGVGRSFTKEVIETMSSINERPIILALSNPTSQSECTAEEAYTWSQGRAIFGSGSPFDPVKYNAKLFVPAQANNAYIFPGFGLGVVISGAVRVTDDMVLAAAEGLADQVTPEHIDKGLIYPPFSIIRKISANIAARVAAKAYDLGLASQLPRPKDLVKYAESCMYTPIYRSYR

SEQ ID NO: 7542 - protein, 585 aa, Oryza sativa
MAGRGEGNGAATMAGVATGGVEDAYGEDRATEDQPITPWAVCVASGHSLLRDPRHNKGLSFTEKERDAHYLRGLLPPVVLSQELQEKRLLQNVRQFQVPLQRYMALMDLQERNERLFYKLLIDNVEELLPVVYTPTVGEACQKYGSIFRRPQGLYISLKEKGRILELLRNWPEKSIQVIVVTDGERILGLGDLGCQGMGIPVGKLALYTALGGVRPSACLPITIDVGTNNEDLLKDEFYIGLRQKRATGQEYSDLLDEFMAAIKQNYGQKVLVQFEDFANYNAFTLLEKYRANNLVFNDDIQGTAAVVLAGLIAAQKFVSGTLADHTFLFFGAGEAGTGIAELVALEISNQSKVPVEDARKKIWLLDSKGLIVSSRKDSLQPFKKRYAHEHEPVKDLLDAVKVIKPTALIGSAGVGQSFTKEVIEAMSSINERPIILALSNPTSQSECTAEQAYSWSKGRAIFGSGSPFDPVKYNDKLFVPAQANNAYIFPGFGLGVVISGAIRVKDEMILAAAEGLADQVTPEHVDKGLIYPPFSCIRKISANIAARVAAKAYDLGLASHLPRPKDLVKYAESCMYSPIYRSYR

SEQ ID NO: 7543 - protein, 596 aa, Setaria italica
GSGELKNGGVTGGVEDAYGEDRATEDQPVTPWAVCIASGHSILRDPRHNKGLSFTEKERDAHYLRGLLPPVVLSQDLQLLFLHLEKRLLQNVRQFEVPLQRYMALMDLQERNERLFYKLLIDNVEELLPVVYTPTVGEACQKYGSIFRRPQGLYISLKEKGRILEVLRNWPEKSIQVIVVTDGERILGLGDLGCQGMGIPVGKLALYTALGGVRPSACLPITIDVGTNNENLLKDEFYIGLKQRRATGQEYSELLDEFMTAVRQNYGQKVLVQFEDFANHNAFTLLEKYRENHLVFNDDIQGTAAVVLGGLIAALKSVGGTLADHTFLFFGAGEAGTGIAELVALEISGQAKVSVEEARKKIWLVDSKGLIVTSRNETLQPFKKRYAHEHEPVKDLLGAVKAIRPTALIGSAGVGQSFTKEVIEAMSSINERPIILALSNPTSQSECTAEQAYTWSRGRAIFGSGSPFDPVKYNDKLFVPAQANNAYIFPGFGLGVVISGAVRVTDDMVLAAAEGLADQVTPEHIDKGLIYPPFSIIRKISANIAARVAAKAYDLDDSYEPSRSSAFGLASQLPRPKNLVKYAESCMYTPVYRSYR

SEQ ID NO: 7544 - protein, 573 aa, Oryza sativa
MAGVATGGVEDAYGEDRATEDQPITPWAVCVASGHSLLRDPRHNKGLSFTEKERDAHYLRGLLPPVVLSQELQEKRLLQNVRQFQVPLQRYMALMDLQERNERLFYKLLIDNVEELLPVVYTPTVGEACQKYGSIFRRPQGLYISLKEKGRILELLRNWPEKSIQVIVVTDGERILGLGDLGCQGMGIPVGKLALYTALGGVRPSACLPITIDVGTNNEDLLKDEFYIGLRQKRATGQEYSDLLDEFMAAIKQNYGQKVLVQFEDFANYNAFTLLEKYRANNLVFNDDIQGTAAVVLAGLIAAQKFVSGTLADHTFLFFGAGEAGTGIAELVALEISNQSKVPVEDARKKIWLLDSKGLIVSSRKDSLQPFKKRYAHEHEPVKDLLDAVKVIKPTALIGSAGVGQSFTKEVIEAMSSINERPIILALSNPTSQSECTAEQAYSWSKGRAIFGSGSPFDPVKYNDKLFVPAQANNAYIFPGFGLGVVISGAIRVKDEMILAAAEGLADQVTPEHVDKGLIYPPFSCIRKISANIAARVAAKAYDLGLASHLPRPKDLVKYAESCMYSPIYRSYR

SEQ ID NO: 7545 - protein, 588 aa, Brachypodium distachyon
MAGRSGEGAPSSDAAMAGVATGGVEDAYGEDRATEDQPVTPWAVCIASGHSLLRDPRHNKGLSFTEKERDAHYLRGLLPPVVLSQELQEKRLLQNVRELQVPLQRYMFLMDLQERNERLFYKLMIDNVEELLPVVYTPTVGEACQKYGSIFRRSQGLYISLKDRGRVLEVLRNWREKSIQVIVVTDGERILGLGDLGCQGMGIPVGKLALYTALGGVRPSACLPITIDVGTNNEELLNDEFYIGLRQKRATGQEYAELLDEFMAAVKQNYGQKVLVQFEDFANHNAFTLLEKYRPTHLAFNDDIQGTAAVVLAGLIAGLKFVGGTLADHTFLFFGAGEAGTGIAELVALEISMQSKVSQEDARKNIWLVDSKGLIVSSRKDSIQPFKKLYAHEHEPVKDLLSAIKDIKPTALIGSAGVGQSFTKEVIEAMSSINKRPIILALSNPTSRSECTAEQAYSWSQGRAIFGSGSPFDPVKYNEKLFVPAQANNAYIFPGFGLGVVISGAIRVKDDMVLAAAEGLAEQVSSEHFDKGLIYPPFSSIRKISANIAARVAAKAYDLGLASHLPRPRDLVKYAESCMYSPIYRSYR

SEQ ID NO: 7546 - protein, 585 aa, Triticum aestivum
MAGRSGEEADAAMAGVATGGVEDAYGEDRATEDQPVTPWAVCIASGHSLLRDPRHNKGLSFTEKERDAHYLRGLLPPVVLSQELQEKRLLQNVRQLDVPLQRYMFLMDLQERNERLFYKLMIDNVEELLPVVYTPTVGEACQKYGSIFRRSQGLYISLKDKGRVLEVLRNWPEKSIQVIVVTDGERILGLGDLGCQGMGIPVGKLALYTALGGVRPSACLPITIDVGTNNEELLNDEFYIGLRQRRATGQEYTELLDEFMVAVKQNYGQKVLVQFEDFANHNAFTLLDKYKATHLVFNDDIQGTAAVVLAGLMAGLKFAGGTLADHTFLFFGAGEAGTGIAELVALEISMQSKTSQEEARKNIWLVDSKGLIVSSRKDSIQPFKKLYAHEHEPVKDLLSAIKDIKPTALIGSAGVGQSFTKEVIEAMSSINKRPIILALSNPTSKSECTAEQAYSWSQGRAIFGSGSPFDPVKYNDKLFVPAQANNAYIFPGFGLGVVISGAIRVKDDMVLAAAEALAEQVTAEHFDKGLIYPPFSSIRKISANIAARVAAKAYDLGLASHLPRPKDLVKYAESCMYSPIYRSYR

SEQ ID NO: 7547 - protein, 573 aa, Brachypodium distachyon
MAGVATGGVEDAYGEDRATEDQPVTPWAVCIASGHSLLRDPRHNKGLSFTEKERDAHYLRGLLPPVVLSQELQEKRLLQNVRELQVPLQRYMFLMDLQERNERLFYKLMIDNVEELLPVVYTPTVGEACQKYGSIFRRSQGLYISLKDRGRVLEVLRNWREKSIQVIVVTDGERILGLGDLGCQGMGIPVGKLALYTALGGVRPSACLPITIDVGTNNEELLNDEFYIGLRQKRATGQEYAELLDEFMAAVKQNYGQKVLVQFEDFANHNAFTLLEKYRPTHLAFNDDIQGTAAVVLAGLIAGLKFVGGTLADHTFLFFGAGEAGTGIAELVALEISMQSKVSQEDARKNIWLVDSKGLIVSSRKDSIQPFKKLYAHEHEPVKDLLSAIKDIKPTALIGSAGVGQSFTKEVIEAMSSINKRPIILALSNPTSRSECTAEQAYSWSQGRAIFGSGSPFDPVKYNEKLFVPAQANNAYIFPGFGLGVVISGAIRVKDDMVLAAAEGLAEQVSSEHFDKGLIYPPFSSIRKISANIAARVAAKAYDLGLASHLPRPRDLVKYAESCMYSPIYRSYR

SEQ ID NO: 7548 - protein, 582 aa, Hordeum vulgare
MAGRPGEEADAAMATGGVEDSYGEDRATEDQPVTPWAVCIASGHSLLRDPRHNKGLSFTEKERDAHYLRGLLPPVVLPQDLQEKRLLQNVRQLEAPLQRYMFLMDLQERNERLFYKLMIDNVEELLPVVYTPTVGEACQKYGSIFRRSQGLYISLKDKGRVLEVLRNWPEKSIQVMVVTDGERILGLGDLGCQGMGIPVGKLALYTALGGVRPSACLPITIDVGTNNEELLNDEFYIGLRQKRATGQEYTELLDEFMAAVKQNYGQKVLVQFEDFANHNAFTLLEKYKATHLVFNDDIQGTAAVVLAGLMAGLKFAGGTLADHTFLFFGAGEAGTGIAELVALEISMQSKISQEEAHKNIWLLDSKGLIVSSRKDSIQPFKKLFAHEHEPVKDLLSAIKDIKPTALIGSAGVGQSFTKEVIEAMSSINERPIILALSNPTSKSECTAEQAYSWSQGRAIFGSGSPFDPVKYNGKLFVPAQANNAYIFPGFGLGVVISGAIRVKDDMVLAAAEALAEQVTAEHFDKGLIYPPFSSIRKISANIAARVAAKAYDLGLASHLPRPKDLVKYAESCMYSPIYRSYR

SEQ ID NO: 7549 - protein, 636 aa, Setaria italica
MASVSAVLLQRASSRAREYLHLQRAAGGTVALHLERLHYWWWSSGGGRFGARAAHGMAGSGELKNGGVTGGVEDAYGEDRATEDQPVTPWAVCIASGHSILRDPRHNKGLSFTEKERDAHYLRGLLPPVVLSQDLQEKRLLQNVRQFEVPLQRYMALMDLQERNERLFYKLLIDNVEELLPVVYTPTVGEACQKYGSIFRRPQGLYISLKEKGRILEVLRNWPEKSIQVIVVTDGERILGLGDLGCQGMGIPVGKLALYTALGGVRPSACLPITIDVGTNNENLLKDEFYIGLKQRRATGQEYSELLDEFMTAVRQNYGQKVLVQFEDFANHNAFTLLEKYRENHLVFNDDIQGTAAVVLGGLIAALKSVGGTLADHTFLFFGAGEAGTGIAELVALEISGQAKVSVEEARKKIWLVDSKGLIVTSRNETLQPFKKRYAHEHEPVKDLLGAVKAIRPTALIGSAGVGQSFTKEVIEAMSSINERPIILALSNPTSQSECTAEQAYTWSRGRAIFGSGSPFDPVKYNDKLFVPAQANNAYIFPGFGLGVVISGAVRVTDDMVLAAAEGLADQVTPEHIDKGLIYPPFSIIRKISANIAARVAAKAYDLGLASQLPRPKNLVKYAESCMYTPVYRSYR

SEQ ID NO: 7550 - protein, 290 aa, Brachypodium distachyon
MCYYIAQKVIPCVIFQSKVSPEEARKNIWLVDIDGLIVSSRKYSIQPIQKLYAHEHEPVKDLLSAIKDIKPTALIGSAGVGQSFTKEVIETMSSINQRPVILALSDPTSRSECTAEQAYSWSQGRAIFGSGSPFDPVKYNKKLFVPAQANNAYIFPGFGLGVVISGAIRVKDDMVLSAAEGLAEQVTSEHFDKGLIYPPFCSIRKISANIAARVAAKAYDLGLASHLPRPRDLAKYAESCMYSHIYRSYRWSHGGCICSTLARDNVRLDLDCDLLGCFRCTGACLFISSQ

SEQ ID NO: 7551 - protein, 191 aa, Zea mays
MGVHARSMSWYMGSPAPGSAAEGEGQRALRSSSGGSDGSFDTNMVIILAALLFALLFAMGLNSLARCLIRWARRAPAGEDGGAGGLKKRALRSIPVEVYGACGADGAAAVAADVCAICLGEFADGEKVRVLPRCAHGFHVRCVDTWLLSHDSCPTCRGSVLDGAKAAASAPAAGGNRRQGSEAAAIAIVIG

SEQ ID NO: 7552 - protein, 211 aa, Setaria italica
MGVHVRSMSWYLGPPGSPAPAGSAAAEAQHALSSNPGGSDTSFDTNMVIILAALLFALLFALGLNSLARCLIRWARRAASVGEGGAGAGAGGGRGGGGLKRRALRSLPVEVYGACSADGSAAGAADVCAICLGEFADGEKVRVLPRCAHGFHVRCVDTWLLSHDSCPTCRGTVLDAAAAGNAKAAASAPAAAAGGSRRQGSEAAAIAVVIG

SEQ ID NO: 7553 - protein, 318 aa, Zea mays
MALPAAGTPPFLTKTYAMVEDSATDDTISWNDTGTAFVVWRPAEFARDLLPKHFKHSNFSSFVRQLNTYGFKKVVGDRWEFANDGFRRGEKHLLAGIQRRKGTGAVAAVPVPGIPAGIPLPLSSPPTSSGGEPAVSSSPPRGSTAGVSGAVAELEEENARLRRENARLARELARARRLCDGVRQLMARYDDDQGRGGDEDPADGDEGHGGSGEGPSGPEVKPMLFGVPIGAKRLRGARGDGDDVDDGEDNDEEQDEDDERQTVRKQGVKAARRNEASDLDVLTLSVRAAAAARTGGGSRDRKSPINAHPDRSLSLGLK

SEQ ID NO: 7554 - protein, 288 aa, Panicum virgatum
MVEDPSTDDTISWNDTGTAFVVWRPAEFARDLLPKHFKHSNFSSFVRQLNTYGFKKVVADRWEFANDGFRRGEKHLLGGIQRRKGTGPGGAGGGAAIPTGIPIISSPPTSSGGEPAVSSSPPRGSAAGVSGAVAELEEENARLRRENARLARELARARRLCDGVRQLVARYDHGGGGEDDPADGDDGHGGGPGGHGAKPMLFGVAIGAKRPRGAEDGDEEEDVDGAAEEDGEEDEEHDDDEKHAARRRGSKAARRKEISDLDVLALSVRAAAAARPGGGSRDRKSSVS

SEQ ID NO: 7555 - protein, 306 aa, Setaria italica
MASPAAGTPPFLTKTYAMVEDPSTDDTISWNDTGTAFVVWRPAEFARDLLPKHFKHSNFSSFVRQLNTYGFKKVVADRWEFANDGFRRGEKHLLGGIQRRKGTGTTGVGGGVAIPAGIPIISSPPTSSGGEPAVSSSPPRGSAAGVSGAVAELEEENARLRRENARLARELARARRLCDGVRQLVARYDHGDEDPAEGDDGHGGGGGGGGPSGRGAKPMLFGVAIGAKRPRGAEDGDEVEDGEDGTAEEDGEEDEEQYDDERHAARGSKAARRKEVSDLDVLALSVRAAAAARPGGGSRDSKSSVS

SEQ ID NO: 7556 - protein, 294 aa, Setaria italica
MEDVRKRGTADGANGASAGGKRARESESFQTGVGSKTKPCTKFFSTSGCPFGEGCHFLHCFPGGYQAVSKITNLGGPAVTPPGRMMMDGPPTPTMKTRLCNKYKTADGCKWGDKCHFAHGERELGKPMLMDSSTHFPMGPGPTGHFAPPPMVNPGMATPASFGASATAKISVDASLAGRIIGRGGVNTKQISRVTGAKLAIRDHESDTKLKNIELEGTFDQIKNASAMVGELIVNISGSAPPPAKNPAGGPHRGGSGSNFKTKMCENFAKGSCTFGDRCHFAHGENELRKPAAA

SEQ ID NO: 7557 - protein, 300 aa, Oryza sativa
MEVGGRKRGKPDGANGAGGKRARESESFQTGVGSKSKPCTKFFSTSGCPFGEGCHFLHHFPGGYQAVAKMTNLGGPAIAPPPGRMPMGNAVPDGPPTPTVKTRLCNKYNTAEGCKWGDKCHFAHGERELGKPMLMDSSMPPPMGPRPTGHFAPPPMPSPAMSTPASFGASATAKISVDASLAGGIIGRGGVNTKQISRVTGAKLAIRDHESDTNLKNIELEGTFDQIKNASAMVRELIVSIGGGAPPQGKKPVGGSHRGGGPGSNFKTKLCENFTKGSCTFGDRCHFAHGENELRKSAAA

SEQ ID NO: 7558 - protein, 276 aa, Saccharum officinarum
RSWPRRFATQTLTEGLRRREAIASTSGCPFGEGCHFLHYFPGGYQAVSKMTNLGGATIAPPGRMTMDGPPTPTVKTRLCNKYNTAEGCKWGGKCHFAHGERELGKPMLMDSYMPPPMGPRPTGHFAPPPMANLGLATPASFGASATAKISVDASLAGGIIGRGGVHTKQISRVTGAKLAIRDHESDSSLKNIELEGTFDQIRNASAMVSELIVSISGNAPSQAKNPAGGTHRGGGGGTGSNFKTKMCENFTKGSCSFGNKCHFAHGDNELRKPAAA

SEQ ID NO: 7559 - protein, 1042 aa, Zea mays
MERLESYLKEHFDVPPKNPSEEAQRRWRSAVGALVKNRRRRFRMVPDLHRRSLDEAQRRSTQEKIRLALYVQKAAMTFIDGAKHKDYRITEDIRNAGFSINPDELASITSKHDAKALKMHGGVDGVSKKIRSALDHGISASDLDTRQSIYGVNRYAEKPSRTFWMFVWDALQDMTLIILMVCALLSAAVGLASEGWPRGMYDGLGIMLSILLVVMVTAVSDYRQSLQFKELDNEKKKIFIHVTRDGSRQKVSIYDLAVGDIVHLSIGDQVPADGLYVHGYSLLIDESSLSGESEPVYVSQDKPFILAGTKVQDGSAKMMVTAVGMRTEWGRLMSTLSEGGEDETPLQVKLNGVATIIGKIGLLFATLTFVVLMVRFLIEKGLTVGLSKWYSTDALTIVNYFATAVTIIVVAVPEGLPLAVTLSLAFAMKKLMNDKALVRHLSACETMGSAGTICTDKTGTLTTNHMVVDKIWASEVSKSVTDSSSLEDLASAVSPATLSLLLQGIFENTSAEVVNEKDGKQTVLGTPTERAIFEFGLKLEGLGAEDRTCTKVKVEPFNSVKKKMAVLVSLHDGGSYRWFTKGASEIVVEMCDMMIDGDGNSVPLSEAQRKIVLDTINSFASDALRTLCLAYKDVDGLEDDDDDADSPTSGFTLICIFGIKDPLRPGVKDAVEACKSAGIVVRMVTGDNINTAKAIAKECGILTDGDLAIEGPEFRSKSPEEMRDIIPKIRVMARSLPLDKHTLVTNLRGMFREVVAVTGDGTNDAPALHEADIGLAMGIAGTEVAKESADVIVLDDNFTTIINVARWGRAVYINIQKFVQFQLTVNIVALVINFVSACITGSAPLTAVQLLWVNMIMDTLGALALATEPPNDDMMKRPPVGRGESFITKVMWRNIIGQSLYQLVVLGALMFGGEQFLNIKGADSKSVVNTLIFNSFVFCQVFNEINSREMEKINVFRGMVTNWIFIAIIAATVLFQVVIVELLGTFASTVPLDWRLWLLSVGLGSVSLVVGAVLKCIPVAKSNGAPASPNGYAPLPSGPDDI

SEQ ID NO: 7560 - protein, 1039 aa, Setaria italica
MEWLEKSLQEDFDLPPKHPSEEALRRWRSAVSFVKNRRRRFRMVADLDTRSQNEARRRSVQENFRNFRVALYVHKAAFNFIDGAKNKEYRITEDIINAGFSINPDELASITSKHDVKALKMHGGVDGISKKIRSTFERGISASDLDTRQNIYGVNRYAEKPSRSFWMFVWDALQDMTLIILMVCALLSAVVGLASEGFPKGMYDGLGIILSILLVVMVTAISDYRQSLQFKELDNEKKKIFIHVTRDGSRQKISIYDLVVGDIVHLSIGDQVPADGLYIHGYSLLIDESSLSGESDPVYISQEKPFLLAGTKVQDGSAKMMITAVGMRTEWGRLMSTLSEGGEDETPLQVKLNGVATIIGKIGLVFATLTFVVLMVRFLIEKGLTVGLSKWYSTDALTIVNYFATAVTIIVVAVPEGLPLAVTLSLAFAMKKLMNDKALVRHLSACETMGSAGTICTDKTGTLTTNHMVVDRIWISEVSKSVTSDNSLEDLNSVISPTTLGLLLQGIFENTSAEVVKEKDGTQTVLGTPTERAILEFGLKLEGHNAEDRTCTKVKVEPFNSVKKKMAVLVSLPNGTYRWFSKGASEIIVQMCDMMVDADGNSVPLSEAQRKDILDTINSFASDALRTLCLAYKEVDDFDDDSDSPTGGFTLISIFGIKDPVRPGVKDAVKACMSAGIIVRMVTGDNINTAKAIAKECGILTDDGVAIEGPDFRSKSPEEMRDLIPKIRVMARSLPLDKHTLVTNLRGMFHEVVAVTGDGTNDAPALHEADIGLAMGIAGTEVAKESADVIVLDDNFTTIISVARWGRAVYINIQKFVQFQLTVNIVALVINFVSACITGSAPLTAVQLLWVNMIMDTLGALALATEPPNDDMMKRPPVRRGESFITKVMWRNIIGQSLYQLVVLGALMFGGEQLLNIKGSDSKSVINTLIFNSFVFCQVFNEINSREMQKINVFRGMISNWIFIGIIAVTVAFQVVIIEFLGTFASTVPLSWQLWLVSVGLGSISLIVGAILKCIAVNSDASPSSPNGYVPLPSGPDNI

SEQ ID NO: 7561 - protein, 1037 aa, Setaria italica
MDWFEKSLQKNFDLPPKNASEEARRRWRSAVGALVKNPRRRFRMVADLDTRSQNELMRRSAQEKIRVAIYVQQAALNFIDGAKYKEYRITEDIINAGFSINPDELASITSKHDVKALKMHGGVDGISKKIRSTFERGISASDLDTRQNIYGVNRYAEKPSRSFWMFVWDALQDVTLIILMVCALISAVVGLASEGFPKGMYDGLGIILSILLVVMVTAISDYRQSLQFKELDNEKKKIFIHVTRDGSRQKISIYDLVVGDIVHLSIGDQVPADGLYTHGYSLLIDESSLSGESDPVYISQEKPFLLAGTKVQDGSAKMMVTAVGMRTEWGRLMSTLSEGGEDETPLQVKLNGVATIIGKIGLVFATLTFVVLMVRFLIEKGLTVGLSKWYSTDALTIVNYFATAVTIIVVAVPEGLPLAVTLSLAFAMKKLMNDKALVRHLSACETMGSAGTICTDKTGTLTTNHMVVDRIWISEVSKSVTSDNSLEDLNSVISPTTLGLLLQGIFENTSAEVVKEKDGTQTVLGTPTERAILEFGLKLEGHNTEDRTCTKVKVEPFNSVKKKMAVLVSLPNGTYRWFSKGASEIIVQMCDMMVDADGNSVPLSEAQRKDILDTINSFASDALRTLCLAYKEVDDFDDDSDSPTGGFTLISIFGIKDPVRPGVKDAVKACMSAGIIVRMVTGDNINTAKAIAKECGILTDDGVAIEGPDFRSKSPEEMRDLIPKIRVMARSLPLDKHTLVTNLRGMFHEVVAVTGDGTNDAPALHEADIGLAMGIAGTEVAKESADVIVLDDNFATIINVARWGRAVYINIQKFVQFQLTVNIVALVINFVSACITGSAPLTAVQLLWVNMIMDTLGALALATEPPNDDMMKRPPVRRGESFITKVMWRNIIGQSLYQLVVLGALMFGGEQLLNIKGSDSKSVINTLIFNSFVFCQVFNEINSREMQKINVFRGMFSNWIFIGIIAVTVAFQVVIIEFLGTFASTVPLNWQLWLVSVGLGSISLIVGAILKCIPVNSDASPSSPNGYVPLPSGPDNI

SEQ ID NO: 7562 - protein, 1037 aa, Sorghum bicolor
MEWLEKNLQEKFDLPPKNRSEEALRRWRDAVSVVKNPRRRFRMVADLASRQQNELKRRSVQEKIRVALYVQQAALNFIDGVKHKDYRLTDDIIKAGFSINPDELASITSKHDMKVLKMHGGVDGISTKVRSSFDHGISASNLDTRQTIYGENRYTEKPPRSFWMFVWDALQDMTLIILMVCALLSAVVGLASEGWPKGMYDGLGIILSILLVVMVTAVSDYRQSLQFKELDNEKKKIFIHVTRDGCRQKISIYDLVVGDIVHLSIGDQVPADGLYIHGYSLLIDESSLSGESEPVYISQDKPFILAGTKVQDGSAKMLVTAVGMRTEWGRLMSTLSEGGEDETPLQVKLNGVATIIGKIGLLFATLTFVVLMVRFLIEKGLTVGLSKWYSTDALTIVNYFATAVTIIVVAVPEGLPLAVTLSLAFAMKKLMNDKALVRHLSACETMGSAGTICTDKTGTLTTNHMVVDKIWISEVSKSLTSNNSLEDLNSAISPATLSLLLQGIFENTSSEVVKDKDGGQTVLGTPTERAILEFGLKLEGHHDAEDRSCTKVKVEPFNSVKKKMAVLVSLPNGKYRWYTKGASEIIVQMCDMMIDGDGNSVPLSEAQRKNVLGTINSFASDALRTLCLAYKEGDDFSDDTDSPTGGFTLISIFGIKDPVRPGVKEAVEACMSAGIIVRMVTGDNINTAKAIAKECGILTDGGIAIEGPEFRNKSPEEMRDLIPKIQVMARSLPLDKHTLVTNLRGMFKEVVAVTGDGTNDAPALHEADIGLAMGIAGTEVAKESADVIVLDDNFTTIINVARWGRAVYINIQKFVQFQLTVNIVALVINFVSACITGSAPLTAVQLLWVNMIMDTLGALALATEPPNDDMMKRPPVGRGESFITKVMWRNIIGQSLYQLAVLGALMFGGERLLNLKGADSKSVINTLIFNSFVFCQVFNEINSREMQKINVFRGMFSNWIFIGIIAVTAAFQVVIIEFLGTFASTVPLSWQLWLVSVGLGSISLIVGVILKCIPVKSDGTRASPNGYAPLPSGPDNI

SEQ ID NO: 7563 - protein, 921 aa, Oryza sativa
MHGGVDGISKKVRSSFDHGICASDLDTRQNIYGVNRYAEKPSRSFWMFVWDAFQDMTLIILMVCALLSVAVGLATEGWPKGMYDGLGIILSIFLVVMVTAVSDYKQSLQFKELDNEKKKIFIHVTRDGRRQKISIYDLVVGDIVHLSIGDQVPADGLYIHGYSLLIDESSLSGESDPVYVSQDKPFILAGTKVQDGSAKMIVTAVGMRTEWGKLMSTLSEGGEDETPLQVKLNGVATVIGKIGLVFAILTFLVLLVRFLIDKGMTVGLLKWYSTDALTIVNYFATAVTIIVVAVPEGLPLAVTLSLAFAMKKLMNDKALVRHLSACETMGSAGTICTDKTGTLTTNYMVVDKIWISEVSKSVTSNTISGELNSVVSSRTLSLLLQGIFENTSAEVVKEKDGKQTVLGTPTERAILEFGLGLEGVHDAEYSACTKVKVEPFNSVKKKMAVLISLPSGTSRWFCKGASEIILQMCDMMVDGDGNAIPLSEAQRKNILDTINSFASDALRTLCLAYKEVDDDIDDNADSPTSGFTLIAIFGIKDPVRPGVKDAVKTCMSAGITVRMVTGDNINTAKAIAKECGILTEDGVAIEGPEFHSKSPEEMRDLIPNIQVMARSLPLDKHTLVTNLRGMFDEVVSVTGDGTNDAPALHEADIGLAMGIAGTEVAKESADVIVLDDNFTTIINVARWGRAVYINIQKFVQFQLTVNIVALVINFVSACITGSAPLTAVQLLWVNMIMDTLGALALATEPPNDEMMKRPPVRKGESFITKVMWRNIMGQSLYQLFVLGALMFGGESLLNIKGADSKSIINTLIFNSFVFCQVFNEINSREMQKINVFRGIISNWIFIAVIAATVAFQVVIIEFLGTFASTVPLNWQHWLLSVGLGSISLIVGVILKCIPVGSGETSATPNGYRPLANGPDDI

SEQ ID NO: 7564 - protein, 1035 aa, Brachypodium distachyon
MERYLQENFELPSKNPSEEAQRRWRSAVGTLVKNRRRRFRHVPDLDQRHQDHAKRRSVQEKIRVALYVQQAAITFIGGAKKNEYQLTEDIIKAGFSINPEELASITSKHDLKALKMHGGVDGISKKIRSTFDRGISCSDLDTRQNIYGVNRYAEKPSRSFWSFVWDALQDMTLIILMVCALLSVVVGLASEGWPKGMYDGLGIILSILLVVMVTAASDYKQSLQFKELDNEKKNIFIHVTRDGSRQKVSIYDLVVGDIVHLSIGDQVPADGIFIHGYSLLIDESSLSGESEPVYTSQDKPFILAGTKVQDGSAKMIVTSVGMRTEWGRLMSTLSEGGEDETPLQVKLNGVATIIGKIGLVFATLTFVVLMARFLVDKGLTVGLSKWYSTDALTIVNYFATAVTIIVVAVPEGLPLAVTLSLAFAMKKLMNDKALVRHLAACETMGSAGTICTDKTGTLTTNHMVVDKIWIAEISKSVTSNNSLEDLNSAISSSAWSLLLQGIFENTSAEVVEGKDGKQTVLGTPTEIAIFEYGLKLQGYRDAEDRTCTKVKVEPFNSVKKKMAVLISLPGGTNRWFCKGASEIVVEMCDMVIDEDGNAIPLSDARKKNIIDTINSFASDALRTLCLAFKDVDDFDEDADSPPSGFTLIVIFGIKDPVRPGVKEAVQSCISAGIIVRMVTGDNINTAKAIAKECGILTDDGIAIEGPDFRTKSPEEMMDLIPKIQVMARSLPLDKHLLVTNLRGMFQEVVAVTGDGTNDAPALHEADIGLAMGIAGTEVAKESADVIVLDDNFTTIINVARWGRAVYINIQKFVQFQLTVNIVALVINFVSACITGSAPLTAVQLLWVNMIMDTLGALALATEPPNDEMMKRPPVGRGESFITNVMWRNIIGQSIYQLIVLGVLMFGGETFLNIKGADSKTVINTLIFNSFVFCQVFNEVNSREMEKINVFRGLLSNWVFIGVISATVVFQVVIIEFLGTFASTVPLSWEHWLVSVGLGSISLIIGAILKCIPVKSGEISASPNGYRQLANGPDDI

SEQ ID NO: 7565 - protein, 1039 aa, Oryza sativa
MEKLDRYLQENFDVPAKNPSEEAQRRWRQAVGTIVKNRRRRFRWVPDLERRSLDKAKVRSTQEKIRVALYVQQAALIFSDGAKKKEYKLTGDIIKAGYAINPDELALITSKHDSKALKMHGGVDGISIKVRSSFDHGIYASELDTRQNIYGVNRYAEKPSRSFWMFVWDALQDMTLIILMVCALLSVAVGLATEGWPKGMYDGLGIILSIFLVVMVTAVSDYKQSLQFKELDNEKKKIFIHVTRDGRRQKISIYDLVVGDIVHLSIGDQVPADGLYIHGYSLLIDESSLSGESDPVYVSQDKPFILAGTKVQDGSAKMIVTAVGMRTEWGKLMSTLSEGGEDETPLQVKLNGVATIIGKIGLVFAILTFLVLLVRFLIDKGMTVGLLKWYSTDALTIVNYFATAVTIIVVAVPEGLPLAVTLSLAFAMKKLMNDKALVRHLSACETMGSAGTICTDKTGTLTTNHMVVDKIWISEVSKSVTSNTISGELNSVVSSSTLSLLLQGIFENTSAEVVKEKDGKQTVLGTPTERAILEFGLGLKGDHDAEYRACTKVKVEPFNSVKKKMAVLISLPNGTSRWFCKGASEIILQMCDMMVDGDGNAIPLSEAQRKNILDTINSFASDALRTLCLAYKEVDDDIDDNADSPTSGFTLIAIFGIKDPVRPGVKDAVKTCMSAGITVRMVTGDNINTAKAIAKECGILTEDGVAIEGPEFHSKSTEEMRDLILNIQVMARSLPLDKHTLVTNLRGMFDEVVSVTGDGTNDAPALHEADIGLAMGIAGTEVAKESADVIVLDDNFTTIINVARWGRAVYINIQKFVQFQLTVNIVALVINFVSACIIGSAPLTAVQLLWVNMIMDTLGALALATEPPNDEMMKRPPVRKGESFITKFMWRNIMGQSLYQLFVLGALMFGGERLLNIKGADSKSIINTLIFNSFVFCQVFNEINSREMQKINVFRGIISNWIFIAVIAATVAFQVVIIEFLGTFASTVPLNWQHWLLSVGLGSISLIVGVILKCIPVGSGETSATPNGYRPLANGPDDI

SEQ ID NO: 7566 - protein, 1017 aa, Oryza sativa
MEKLDRYLQEHFDVPAKNPSEEAQRRWRQAVGTIVKNRRRRFRWVPDLDRRSLDKAKVRSTQEKIRVALYVQQAALIFSDDELALITSKHDSKALKMHGGVDGISKKVRSSFDHGICASDLDTRQNIYGVNRYAEKPSRSFWMFVWDAFQDMTLIILMVCALLSVAVGLATEGWPKGMYDGLGIILSIFLVVMVTAVSDYKQSLQFKELDNEKKKIFIHVTRDGRRQKISIYDLVVGDIVHLSIGDQVPADGLYIHGYSLLIDESSLSGESDPVYVSQDKPFILAGTKVQDGSAKMIVTAVGMRTEWGKLMSTLSEGGEDETPLQVKLNGVATVIGKIGLVFAILTFLVLLVRFLIDKGMTVGLLKWYSTDALTIVNYFATAVTIIVVAVPEGLPLAVTLSLAFAMKKLMNDKALVRHLSACETMGSAGTICTDKTGTLTTNYMVVDKIWISEVSKSVTSNTISGELNSVVSSRTLSLLLQGIFENTSAEVVKEKDGKQTVLGTPTERAILEFGLGLEGVHDAEYSACTKVKVEPFNSVKKKMAVLISLPSGTSRWFCKGASEIILQMCDMMVDGDGNAIPLSEAQRKNILDTINSFASDALRTLCLAYKEVDDDIDDNADSPTSGFTLIAIFGIKDPVRPGVKDAVKTCMSAGITVRMVTGDNINTAKAIAKECGILTEDGVAIEGPEFHSKSPEEMRDLIPNIQVMARSLPLDKHTLVTNLRGMFDEVVSVTGDGTNDAPALHEADIGLAMGIAGTEVAKESADVIVLDDNFTTIINVARWGRAVYINIQKFVQFQLTVNIVALVINFVSACITGSAPLTAVQLLWVNMIMDTLGALALATEPPNDEMMKRPPVRKGESFITKVMWRNIMGQSLYQLFVLGALMFGGESLLNIKGADSKSIINTLIFNSFVFCQVFNEINSREMQKINVFRGIISNWIFIAVIAATVAFQVVIIEFLGTFASTVPLNWQHWLLSVGLGSISLIVGVILKCIPVGSGETSATPNGYRPLANGPDDI

SEQ ID NO: 7567 - protein, 919 aa, Avena sativa
MHGGVDGISKKVRSTFDHGVCAADLDTRQSIYGVNRYAEKPSRSFWSFVWDALQDTTLIILMVCALLSVVVGLASEGWPKGMYDGVGIILSILLVVMVTAASDYKQSLQFKELDNEKKNIFIHVTRDGGRQKISIYDLVVGDIVHLSIGDQVPADGLFIHGYSLLIDESSLSGESEPVYTSQDKPFILAGTKVQDGSAKMIVTAVGMRTEWGRLMSTLSEGGEDETPLQVKLNGVATIIGKIGLVFATLTFVVLMTRFLIEKGTTVGLSKWYSTDALTIVNYFATAVTIIVVAVPEGLPLAVTLSLAFAMKKLMNDKALVRHLAACETMGSAGTICTDKTGTLTTNHMVVDKIWIAELSKSVAGNGSEDLNSSISSSAWNLLLQGIFENTSAEVVKGNDDKQTVLGTPTEIAIFEYGLSLQGYHEAEDRSCTKVKVEPFNSVKKKMAVLVSLPGGSYRWFCKGASEIIVEMCDKVIDQDGDVIPLSDARRKDIMDTIYSFASDALRTLCLAFKDVDDFDEGADSPPSGFTLIIIFGIKDPVRPGVKEAVQSCITAGITVRMVTGDNINTAKAIAKECGILTDDGIAIEGPDFRNKSPDELRDLIPKIQVMARSLPLDKHMLVTNLRGMFQEVVAVTGDGTNDAPALHEADIGLAMGIAGTEVAKESADVIVLDDNFTTIINVARWGRAVYINIQKFVQFQLTVNIVALVINFVSACITGSAPLTAVQLLWVNMIMDTLGALALATEPPNDEMMKRPPVGRGESFITKVMWRNIIGQSIYQLVVLGVLMFGGEKLLGIEGPDSKTVINTLIFNSFVFCQVFNEVNSREMEKINIFRGIIGNWVFIGVITATVVFQVVIIEFLGTFASTVPLSWQFWLVSVGLGSVSLIIGAILKCIPVKSSGISTTPDGYRQLANGPDDI

SEQ ID NO: 7568 - protein, 950 aa, Pennisetum glaucum
RVTEDISNAGFSINPDELASITSKHDVKALKKHGGVDGISRKIRSTFEHGVPASDLDTRQNIYGVNRYAEKPSRSFWMFVWDALQDMTLIILMVCALISAVVGLASEGFPKGMYDGLGIILSILLVVMVTAISDYRQSLQFKELDNEKKKIFIHVTRDGSRQKISIYDLVVGDIVHLSIGDQVPADGLYIHGYSLLIDESSLSGESDPVYISQDKPFLLAGTKVQDGSAKMMVTAVGMRTEWGRLMSTLSEGGEDETPLQVKLNGVATIIGKIGLVFATLTFVVLMVRFLIEKGLTVGLSKWYSTDAMTIVNYFATAVTIIVVAVPEGLPLAVTLSLAFAMKKLMNDKALVRHLSACETMGSAGTICTDKTGTLTTNHMVVDRIWISEVSKSVTSDNSLKDLNSVISPSTLSLLLQGIFENTSAEVVKEKDGRQNVLGTPTERAILEFGLKLEGHNAEDRTCTKVKVEPFNSVKKKMAVLVSLPNGTYRWFSKGASEIVVQMCDMMVDADGNSVPLSEAQRKDILDTINSFASDALRTLCLAYKEADDFNDDSDSPTGGFTLISIFGIKDPVRPGVKDAVKACMSAGIIVRMVTGDNINTAKAIAKECGILTDDGMAIEGPDFRSKSPEEMRALIPKIRVMARSLPLDKHTLVTNLRGMFHEVVAVTGDGTNDAPALHEADIGLAMGIAGTEVAKESADVIVLDDNFATIINVARWGRAVYINIQKFVQFQLTVNIVALVINFVSACITGSAPLTAVQLLWVNMIMDTLGALALATEPPNDDMMKRPPVRRGESFITKVMWRNIIGQSLYQLVVLGALMFGGEQLLNIKGSDSKSVINTLIFNSFVFCQVFNEINSREMQKINVFRGMISNWVFLGIIAVTVAFQVVIIEFLGTFASTVPLNWQLWLVSVGLGFISLIVGAILKCIPVKSDASPSSPNGYVPLPSGPDNI

SEQ ID NO: 7569 - protein, 768 aa, Setaria italica
MPVASQHLSTATPLPPPSPQRQQMMARLEHGSLMVGGRELLARAPPNVTLRPADAEAAPGAAFLGARAAAPSSRHVFPVGTLASGWRWLSLFRFKIWWMVPATGAGAATVPAETQMMLLESRDEEGSAAAEGGAVYALMLPALDGDFRVSLQGSPENELQFCLESGDPEVQTMEAVDAVFINSGDNPFKLMKESIKLLSKIKGNFKHIGDKEIPANLDWFGWCTWDAFYKAVNPAGIEEGLKSLREGGVPPRFLIIDDGWQETVDEFEEVDETLREQTMFAQRLTDLKENHKFRGETCKNLGDLVKRIKEKHGVKYVYMWHALLGYWGGVQVTSDVMKKYNPKLVYPVQSPGNVANLRDIAMDSLEKFGVGIIDPDKIFEFYSDQHSYLSSVGVDGVKVDVQNVLETLGHGFGGRVAVTQKYQQALEESIAQNFKRNNLICCMSHNSDCIFSALKSAVARASEDFMPREPTLQTLHIASVSFNSILLGEIFIPDWDMFHSKHESAEFHGAARALSGGGVYVSDKPGVHDFSVLKKLVLPDGSILRARYAGRPARDCLFNDPVMDGKSLLKIWNLNNFSGVIGVFNCQGAGQWVWPVKDIDYVPTSINITGHLSPSDLESLEEIAGDNWSGETAVYAFNSCSLSRLQKHQNLEVSLSTMACEIYTISPIKVFGEAVQFAPLGLINMFNSGGALDDISSTADSSATTIHVRCRGPGRFGAYSATRPENCRVDGQQVEFCHTEDDLLAFDLPRSSSRDGDLWCIEILYRTS

SEQ ID NO: 7570 - protein, 484 aa, Setaria italica
MATPTVVLLPVWGAGHLMPMLEAGKRLLASSGGRALSVTVLVMRPPTEQQASEVEGHIRRAEEAAAGLDVRFHRLPAVEPPTDHEGPVEFISRTVELHEPHVRAAISGLLPASPVAALVLDLFCTPFIDVARELAVPAYIYFTCNAAALSFFLRLPALCEEVAGEFEDMDGAADIPGLPPVPPLSLPTPVMERTKPECAWYAYHGRRFADADGIVVNTAAELEQGVLSAIADGRCARGGRPPPTLYPIGPVISFPPPTAPPPHDCVRWLETQPPASVAFLCFGSGGFFTAAQAHEVAGGLERSGHRFLWVLRGPPAPGSRQPTDADLAELLPEGFVERTRGRGLVWPTAVPQKEILAHAAVGGFVTHCGWNSMLESLWFGAPMAAWPLYAEQHLNAFALVAAMGAAVAVEVDRARGNFVEAAEVERAVRELMGGGEEAGRRVREKAAEMKAACRNAVGDGGSSTATLKRLANDICQQLRRDPAK

SEQ ID NO: 7571 - protein, 474 aa, Setaria italica
MATPTVVLLPVWGAGHLMPMLEAGKRLLASSGGRALSVTVLVMRPPVEGHIRRAEEAAAGLDVRFHRLPAVEPPTDHEGPVEFISRTVELHEPHVRAAISGLLPASPVAALVLDLFCTPFIDVARELAVPAYIYFTCNAAALSFFLRLPALCEEVAGEFEDMDGAADIPGLPPVPPLSLPTPVMERTKPECAWYAYHGRRFADADGIVVNTAAELEQGVLSAIADGRCARGGRPPPTLYPIGPVISFPPPTAPPPHDCVRWLETQPPASVAFLCFGSGGFFTAAQAHEVAGGLERSGHRFLWVLRGPPAPGSRQPTDADLAELLPEGFVERTRGRGLVWPTAEEILAHAAVGGFVTHCGWNSMLESLWFGAPMAAWPLYAEQHLNAFALVAAMGAAVAVEVDRARGNFVEAAEVERAVRELMGGGEEAGRRVREKAAEMKAACRNAVGDGGSSTATLKRLANDICQQLRRDPAK

SEQ ID NO: 7572 - protein, 157 aa, Panicum virgatum
MMMAEVANHSKRNHTDSYFSGKAVVTTTSSEEFGSMTSKKPRNTSPRTSPVSPKEKKDKIGERVAALQQLVSPFGKTDTASVLQEASGYIKFLHQQLEVLSSPYMRAPPAAGAAPEDPEHYSLRNRGLCLVPVDLTLQLTQSNGADLWAPANTTRRR

SEQ ID NO: 7573 - protein, 161 aa, Zea mays
MMMAEVANHSKRNHTDSYFSGKAVAVPAAAATSSEEFGSMSSKKPRNASPRLAPVSPKEKKDKIGERVAALQQLVSPFGKTDTASVLQEASGYIKFLHQQLEVLSSPYMRAPPAAGAAPEDPQRYSLRSRGLCLVPVDLTLQLTQSNGADLWAPAHTARRR

SEQ ID NO: 7574 - protein, 156 aa, Setaria italica
MMMAEVANHSKRNHTDSYFSGKAVVTTSSEEFGSMISKKPRNTSPRTSPVSPKEKKDRIGERVAALQQLVSPFGKTDTASVLQEASGYIKFLHQQLEVLSSPYMRAPPAAGAAPEDPEHYSLRNRGLCLVPVDLTLQLTQSNGADLWAPANTTRRR

SEQ ID NO: 7575 - protein, 156 aa, Setaria italica
MMMAEVANHSKRNHTDSYFSGKAVVTTSSEEFGSMTSKKPRNTSPRTSPVSPKEKKDRIGERVAALQQLVSPFGKTDTASVLQEASGYIKFLHQQLEVLSSPYMRAPPAAGAAPEDPEHYSLRNRGLCLVPVDLTLQLTQSNGADLWAPANTTRRR

SEQ ID NO: 7576 - protein, 190 aa, Saccharum officinarum
MMMAEVANHSKRNHADSYFSGKAVAAAAAATGPEELGSMSSKKPRNTSPRIAPVSPKEKKDKIGERVAALQQLVSPFGKTDTASVLQEASGYIKFLHQQLEVLSSPYMRASSAGGTGPEDPEQYSLRNRGLGLVPVDLTLELTQSNGADLWAPATRTSAGEERPVGLALAWPEEPAWACLARGNRATNTT

SEQ ID NO: 7577 - protein, 158 aa, Pennisetum glaucum
MMMAEVTNHSKRSHTDSYFSGKAVTTTTTSSEEFGSMTSKKPRNTNARTSPVSPKEKKDKIGERVAALQQLVSPFGKTDTASVLQEASGYIKFLHQQLEVLSSPYMRVPPPPGAAPEDPEHYSLRNRGLCLVPVDQTLQLTQSNGADLWAPANTTRRR

SEQ ID NO: 7578 - protein, 167 aa, Zea mays
MMMAEVVANHSKRSHTDGYFSAKAAVAAAAAASPPEELGSMPMSSKKPRPRNSNSPRTAPVSPKEKKDRIGERVAALQQLVSPFGKTDTASVLQEASGYIRFLHQQLQVLSSPYMRAPPAAGAAPEDPEHYSLRSRGLCLVPVDQTLQLTQSNGADLWAPANTTRRR

SEQ ID NO: 7579 - protein, 165 aa, Triticum aestivum
MMMTQVANHSKRNHTDSYFSGKQQQQAVATTATSSGSEEFAGMGSKKPRNASPRGGGPISPREKKDKVGERVAALQQLVSPFGKTDTASVLQEASGYIKFLHQQLEVLSSPYMRPPPAPGAEPEDPDHYSLRNRGLCLVPVEQTLQLTQSNGADLWAPANTTRRC

SEQ ID NO: 7580 - protein, 163 aa, Pseudoroegneria spicata
MMMTQVANHSKRNHTDGYFSGKQQQAVATTTSSGSEEFGGMGSKKPRNASPRGGGPISPKEKKDKVGERVAALQQLVSPFGKTDTASVLQEASGYIKFLHQQLEVLSSPYMRPPPAPGAEPEDPDHYSLRNRGLCLVPVEQTLQLTQSNGADLWAPANTTRRC

SEQ ID NO: 7581 - protein, 163 aa, Leymus cinereus x Leymus triticoides
  misc_feature (14)..(14): Xaa can be any naturally occurring amino acid
  misc_feature (27)..(27): Xaa can be any naturally occurring amino acid
  misc_feature (32)..(32): Xaa can be any naturally occurring amino acid
  misc_feature (143)..(143): Xaa can be any naturally occurring amino acid
MMMTQVANHSKRNXTDSYFSGKQQAVXTTTTXSGSEEFGGMGSKKPRNASPRGGGPISPKEKKDKVGERVAALQQLVSPFGKTDTASVLQEASGYIKFLHQQLEVLSSPYMRPPPAPGAEPEDPDHYSLRNRGLCLVPVEQTXQLTQSNGADLWAPANTTRRC

SEQ ID NO: 7582 - protein, 168 aa, Triticum aestivum
MMMTQVANHSKRNHTDSYFSGKQQQQQQQAGATTTSGGSEEFAGMGSKKPRNASPRGSGGPISPKEKKDKVGERVAALQQLVSPFGKTDTASVLQEASGYIKFLHQQLEVLSSPYMRPPPAPGAEPEDPDHYSLRNRGLCLVPVEQTLQLTQSNGADLWAPANTTRRT

SEQ ID NO: 7583 - protein, 167 aa, Secale cereale
MMMTQVANHSKRNHTDSYFSGKQQQQQAGAATATSSGSGEFGGMGSKKPRNASPRGGGPISPREKKDKVGERVAALQQLVSPFGKTDTASVLQEASGYIKFLHQQLEVLSSPYMRPSPAPGAEPEDPEHYSLRSRGLCLVPVEQTLQLTQSNGADLWAPANTTTRRP

SEQ ID NO: 7584 - protein, 384 aa, Zea mays
MGIYERQRHLVPTGVWGEPFRLDADAVAMPLPLAAFPSVTVATPAPLDVVEPEAEEIKLGKRLLQAQQDDVPRMQEAPPSSDSFSHDDDDARPRDKVQRRLAQNREAARKSRLRKKAYIRNLETSRVKLAQLEQELIMARRQQHGAYGVGGGVAPPAAPVDPRVAAFELEYAHWVEEQSRQATELRAALQSHAPDVQLRVLVDAALAHYGALFQAKARAARSDAFFVLSGVWRSPAERFFLWIAGFRPSDLLKVLEPQLSPLMDHQASEVRKLQNTARQLEDALSQGMSKLQQTLVDTLMTVDVSPDGAGGGYAGQQMACAVGKLADLVDFVDKADHLRQQTLRNMHKILTPRQAARGLLALADYGQRLRALSSLWAARPREPA

SEQ ID NO: 7585 - protein, 287 aa, Zea mays
MDGSSKRIGGGGDDMPSPDHDQNASPNVPPSAAGDGGASATAAAAPAAGRRPFTSLSQEEADLALARVLQEQERAYMMLTGGEYAISDAESYDYDEEDGDGSDYEEEGEALDEDEQVGDAEAEGAEGDLDLDPSQYEDDGEGDVSDRLMALVGIGDWRAMEQDDAGDEEDDEDAEVHTQGAWEDVDPDEYSYEELIALGEVVGTESKGLAADTIASLPWVTYQAQDKQDGNMEQCVICRVEFDEGESLVALPCKHPYHSECINQWLQLNKVCPMCSAEVPTSVNKQA

SEQ ID NO: 7586 - protein, 595 aa, Saccharum officinarum
MDSDVEMNAASDEEVMDDEDYYDYCDSDMGDDGDGGSEEEELVAGDYDEGIEAEGTDEVVSRREQTFVVLNEEVISERQEEDVSKVSAVLLITREEACALLHHYKWNISKLSDEWFADEEKVRHTVGLLLNGNHEPRSRKLTCGICFEGYSSDMMSSAGCAHFYCHECWEGYISAAIGGGPGCLSLRCPDPSCSAMVLQGTINELAKDEDKEKYARFLLRAYVEGSKKTKWCPAPDCTCAVEFLGDENYDVSCNCKFSFCWNCTEEAHRPVNCETVSKWILKNSAESENMNWILANSKPCPKCKRPIEKNQGCMHMTCTPPCKFEFCWLCLGAWSDHGERTGGFYACNRYESAKKEGVYDETEARRERAKNSLERYMHYYERWASNQTSRQKAQSDLLKAEKDQLANLTDIFGIPETQLKFIIEAWSQIIECRRVLKWTYAYGYYLDDKVKSEFFEYLQGEAESGLERLHQCAEKDLQKFLPSVKSDSTETTAPTPDEFSEFRVKLAGLTSVTRNYFENLVQALEAGLEDVRATAQAAGTSSAATSSKKGGTKSKKKQHTKPSSDHTDDGWPCERCTFLNPPSVDACSVCEKSRY

SEQ ID NO: 7587 - protein, 599 aa, Setaria italica
MDSDVEMNAASDEEVMDDEDYYDYCYSDVGDDEDDGGGGDSDGELVGADYDEGLEAEGSDVVVSRREQTFAVLREEDISERQEEDISKVSSVLSIAREEACVLLHHYKWNISKLSDEWFADEEKVRHTVGLLLNGNDRPRSRKLTCGICFEGYSSDMMSSAGCAHFYCHECWEGYISAAISGGPGCLSLRCPDPSCGAMVLQRMINKLAKEEDKEKYARFLLRTYVEGSKKTKWCPAPDCTCAVEFLGDENYDVSCNCKFNFCWNCTEEAHRPVNCETVSKWILKNSAESENMNWILANSKPCPKCKRPIEKNQGCMHMTCTPPCKFEFCWLCLGAWSDHGERTGGFYACNRYESAKKEGVYDETEARRERAKNSLERYMHYYERWASNQTSRQKAQADLHKAEKEQLAKLTDIFGIPETQLKFIVEAWSQIIECRRVLKWTYAYGYYLDDKVKSEFFEYLQGEAESGLERLHQCAEKDLLAFLPSLKPDSNETTAPSVAEFGDFRVKLAGLTSVTRNYFENLVQALEAGLEDVHATGQAAATSSTATSSKKGGTKSKKKHAKPSSDHTDDGWPCERCTYLNPPSVDVCSICEKSRYQT

SEQ ID NO: 7588 - protein, 599 aa, Panicum virgatum
MDSDVEMNAASYQEVMDDEDYYDYDYCYSDAGDDGSGGGGDSEGELAAGDFDEGLEAEGTDEVVSRREQTFAVLSEEDISERQEEDISKVSAVLSINREEACVLLHHYKWNISKLSDEWFADEEKVRHTVGLLLNGNDRPRLRKLTCGICFEGYSSDMMSSAGCAHFYCHECWEGYISAAISGGPGCLSLRCPDPSCGSMVLQGMVNKLAKDEDKEKYARFLLRAYVEGSKKTKWCPAPDCTCAVEFLGDENYDVLCNCKFNFCWNCTEEAHRPVNCETVSKWILKNSAESENMNWILANSKPCPKCKRPIEKNQGCMHMTCTPPCKFEFCWLCLDAWSDHGERTGGFYACNRYESAKKEGVYDETEARRERAKNSLERYMHYYERWASNQTSRQKAQADLHKAEKEQLAKLTDIFGIPETQLKFIIEAWSQIIECRRVLKWTYAYGYYLDDKVKSEFFEYLQGEAESGLERLHQCAEKDLQAFLPSLKPDSNETMTPSVAEFGDFRVKLAGLTSVTRNYFENLVRALEAGLEDVRAAGQAGATSSTATSSKKGVTKSKKKQHSKPSSDHTDDSWPCERCTYLNLPSVDACSVCEKSRY

SEQ ID NO: 7589 - protein, 596 aa, Pennisetum glaucum
MDSDVEMNAASDEEVMDDEDYYDYCYSDVGDDEDEAGGGGDSDGDLVEAGYDEGLEAEGTDEVVSRREQTFAVLSEKDISERQEEEISKVSSVLSIAREDASVLLHHYKWNISKLSDEWFADEEKVRHTVGLLLNGNDRPRSRKVTCGICFEGYSSDMMSSAGCAHFYCHECWEGYISAAISDGPGCLSLRCPDPSCGAMVLQRMVNKIAKEEDKEKYARFLLRAYVEGSKKTKWCPAPDCTCAVEFLGDENYDVSCNCKFSFCWNCTEEAHRPVNCETVSKWILKNSAESENMNWILANSKPCPKCKRPIEKNQGCMHMTCTPPCKFEFCWLCLGAWSDHGERTGGFYACNRYESAKKEGVYDETESRRERAKNSLERYMHYYERWASNQTSRQKAQADLHKAEKEQLAKLSDILGIPETQLKFIIEAWSQIIECRRVLKWTYAYGYYLDDKVKSEFFEYLQGEAESGLERLHQCAEKDLLAFLPSLKPDETTTPSVAEFGDFRVKLAGLTSVTRNYFENLVQALEAGLEDVHATGQAAATSSTATTSKKGGTKAKKKHAKPSSDPTDDGWPCERCTYLNPPSVDACNVCEKSRY

SEQ ID NO: 7590 - protein, 200 aa, Zea mays
MDSDVEMNTASDEEVMDNDDYYDYCYSDVGDDGGSNSGSEELVAGDYDEGLEAEGTDEVVSRREQTFVVLNEQVISERQAEDVSKVSAVTLITREEACALLHHYKWNISKLSDEWFADEEKVRHTVGLLLNGNHDPRSRKARFIFHTLMFLFHQSNACNPLVCGICFEGCSSDMMSSAGCAHFYCHECWEGRSLLLLCYC

SEQ ID NO: 7591 - protein, 418 aa, Setaria italica
MDSDVEMNAASATRTSTTTATANTFAVLREEDISERQEEDISKVSSVLSIAREEACVLLHHYKWNISKLSDEWFADEEKVRHTVGLLLNGNDRPRSRKLTCGICFEGYSSDMMSSAGCAHFYCHECWEGYISAAISGGPGCLSLRCPDPSCGAMVLQRMINKLAKEEDKEKYARFLLRTYVEGSKKTKWCPAPDCTCAVEFLGDENYDVSCNCKFNFCWNCTEEAHRPVNCETVSKWILKNSAESENMNWILANSKPCPKCKRPIEKNQGCMHMTCTPPCKFEFCWLCLGAWSDHGERTGGFYACNRYESAKKEGVYDETEARRERAKNSLERYMHYYERWASNQTSRQKAQADLHKAEKEQLAKLTDIFGIPETQLKFIVEAWSQIIECRRVLKWTYAYGYYLDDKVKSEFFRVPAR

SEQ ID NO: 7592 - protein, 607 aa, Oryza sativa
MDSDAEMPMSSDEEMLDDEDYYDYSDDMGEDDDGSGGGGGGDSDGEEEEEGDEELVGGDYEGREAEGSDEVVSRREQRYIVLTEKDINERQEEDIGKVSAVLSIRREEACVLLHHYKWNISKLSDEWFADEEKVRDIVGLLLNGIDLPNSRKLTCGICFEGYSSDVMSSADCDHFYCHECWEGYISAAISDGPGCLSLRCPDPSCGAMVLQNMINKLAKDDDKVRYARFILRAYVEDSKKTKWCPAPDCTCAVEFVSDGNYDVSCNCKFSFCWNCTEEAHRPVNCETVSRWILKNSAESENMNWILANSKPCPKCKRPIEKNQGCMHMTCTPPCKFEFCWLCLGSWAEHGERTGGFYACNRYESAKKEGVYDETEARRERAKNSLERYMHYYERWASNQTSRQKAQADLQKAEKEQLAKLTDVFGIPETQLKFIIEAWSQIIECRRVLKWTYAYGYYLDDKVKSEFFEYLQGEAESGLERLHQCAEKDLQSFLTVRSDNTEPAPSIAEFGDFRVKLAGLTSVTRNYFENLVQALEAGLEDVHSTAQGTTSSNATNIPSKKAVTKGKTKKQLPRTSSDNSDEGWPCERCTFINPSSVDACSVCDKHRY

SEQ ID NO: 7593 - protein, 598 aa, Triticum aestivum
MDSDSEMPVASDEEMVDDEDYYYYSDEGEGDDGDASGGGASGDEDVSAGDYEGREAEGSDEAVSTREQRYIVLSEKDISERQEEDISEVSALLLIPREEASVLLHHYKWDISKVNDEWFSDEDKVRGIVGLLMNGTDFHNSRKLTCGICFEGYSSDMMSSAGCAHFYCHECWEGYISAAVSQGPGCLSLRCPDPSCSAIVLQGMINKLGKHEDKEKYARFALRAYVESRKKTKWCPAPDCTCAVEFVSDVNYDVSCNCTFRFCWNCTEEAHRPVNCETVSKWILKNSAESENMNWILANSKPCPKCQRPIEKNQGCMHMTCTPPCKFEFCWLCLGSWVEHGERTGGFYACNRYESAKKEGVYDEAEARRERAKHSLERYMHYYERWASNQTSRQKAIADLQKAEKEQLAKLTDIYGIPETQLKFIIEAWSQIIECRRVLQWTYAYGYYLEDKVKSGFFEYLQGEAESGLERLHQCAEKDLLAFLPFSKHDTTEDHPSPAEFGEFRVKLAGLTSITRNYFENLVRALEDGLEDVQCAGEAATSSKATNSKKAGAKGKAAKKQPSRSSSDHSDDTWPCERCTFLNPSSADACTACDKQRY

SEQ ID NO: 7594 - protein, 173 aa, Zea mays
MTKDETLLVFTLVVSSVSIFLFGILLFMVLISATRDFRERTKSKLVKIMIWAGIVVITFAIAVRIYPIFIFLLKERIKPLVEALYDKLPWIWEVSLSRYWDRLIDFLDRYLWACAQRIQTGIRKQKGEFVVTFSCRVKKRLYARAIEVGIHLSLLSNLFWILKTTLAVGYRLL

SEQ ID NO: 7595 - protein, 370 aa, Setaria italica
MNYEFNRCSLAERRIFLAHYQTITYSQTSCGANRFHLPSYGKPFSFRLALSGILVMGSIGTGRSYLVKYLTKNSYFPFIKVRGLLIPQERKHLFILSYTRGFYLEKTMFHTKGFGSITTSSSALDLVALSNEALSISIPHKKSIIETNTIRLALHRQTWGLRAKIRPARDHGTLFYQIGGGLVQNRLLSNNPIDPISIYINRQSCQEAAFSLAKRYFELGTSMKRLTRLLSLLSFSGGPVAQDLWSSPGTDEKFEKGNGMVKPELLEERIFNSITWAPRIWGPWDNLFDCRDRYAEYDWGFSYGYWSGSKQIKEDELSETAIYSNYFWSFHSNTLSESSQYLAKLFLSNGRLLDQMTKTLFVEKEVAFPG

SEQ ID NO: 7596 - protein, 249 aa, Oryza sativa
MTKDETLLVFTLVVSSVSVFLFGILLFMVLISATRDFRERTKSKLVKIMIWAGIVVITFAIAVRIYPIFIFLLKERIKPLVEALYDKLPWIWEVSLSRYWDRLIDFLDRYLWACAQRIQTGIRKQKGEFVVTFSCRVKKRLYARAIEVGIHLSLLSNLFWILKTTLAVGYRLLWVLYYIISFEGFLGSFRLYLVYFGFYCLLFSGKWLRTSEDRGERQAQISGILLRGMLIECAFSVLCLEEDSNLHAL

SEQ ID NO: 7597 - protein, 249 aa, Oryza sativa
MTKDETLLVFTLVVSSVSVFLFGILLFMVLISATRDFRERTKSKLVKIMIWAGIVVITFAIAVRIYPIFIFLLKERIKPLVEALYDKLPWIWEVSLSRYWDRLIDFLDRYLWACAQRIQTGIRKQKGEFVVTFSCRVKKRLYARAIEVGIHLSLLSNLFWILKTTLAVGYRLLWVLYYIISFEGFLGSFRLYLVYFGFYCLLFSGKWLRTSEDRGERQAEISGILLRGMLIECAFSVLCLEEDSNLHAL

SEQ ID NO: 7598 - protein, 249 aa, Oryza sativa
MTKDETLLVFTLVVSSVSVFLFGILLFMVLISATRDFRERTKSKLVKIMIWAGIVVITFAIAVRIYPIFIFLLKERIKPLVEALYDKLPWIWEVSLSWYWDRLIDFLDRYLWACAQRIQTGIRKQKGEFVVTFSCRVKKRLYARAIEVGIHLSLLSNLFWILKTTLAVGYRLLWVLYYIISFEGFLGSFRLYLVYFGFYCLLFSGKWLRTSEDRGERQAQISGILLRGMLIECAFSVLCLEEDSNLHAL

SEQ ID NO: 7599 - protein, 131 aa, Zea mays
MTKDETLLVFTLVVSSVSIFLFGILLFMVLISATRDFRERTKSKLVKIMIWAGIVVITFAIAVRIYPIFIFLLKERIKPLVEALYDKLPWIWEVSLSRYWDRLIDFLDRYLWACAQRIQTGIRKQKGEGNS

SEQ ID NO: 7600 - protein, 129 aa, Zea mays
MTKDETLLVFTLVVSSVSIFLFGILLFMVLISATRDFHERTKSKLVKIMIWAGIVVITFAIAVRIYPIFIFLLKERIKPLVEALYDKLPWIWEVSLSRYWDRLIDFLDRYLWACAQRIQTGIANKKGNS

SEQ ID NO: 7601 - protein, 249 aa, Oryza sativa
MTKDETLLVFTLVVSSVSVFLFGILLFMVLISATRDFRERTKSKLVKIMIWAGIVVITFAIAVRIYPIFIFLLKERIKPLVEALYDKLPWIWEVSLSRYWDRLIDFLDRYLWTCAQRIQTGIRKQKGEFVVTFSCRVKKRLYARAIEVGIHLSLMSNLFWILNTTLAVGYCLLWVLYYIISFEGFLGSFRLYLVYFGFYCLLFSGKWLRTSEDRGERQAQISGILLRGMLIECAFSVLCLEEDSNLHAL

SEQ ID NO: 7602 - protein, 131 aa, Brachypodium distachyon
MTKDETLLVFTLVVSSVSVFLFGILLFMILISATRDFSERTKSKLVKIMIWAGIVVITFAIAVRIYPIFIFLLKERIKPLVEALYDKLPWIWEVSLSRYWDRLLDFLDLIATYGRALKGYKQGFANKKGNS

SEQ ID NO: 7603 - protein, 121 aa, Brachypodium distachyon
MTKDETLLVFTLVVSSVSVFLFGILLFMILISATRDFSERTKSKLVKIMIWAGIVVITFAIAVRIYPIFIFLLKERIKPLVEALYDKLPWIWEVSLSRYWDRLLDFLDLIATYGRALKGYK

SEQ ID NO: 7604 - protein, 610 aa, Zea mays
MGLFSSPAKVYKPAADVDLGPGSDELYISPNVKAPRVAGLLVKIFVWILEMPIVGQIVLYILKKDNLINKLVSDADIPEPPLFTASHSWEDTPEQSVRLTKPDLSAAERVQEAVGCLPARLEAALAADARGIRRWTVRDFSDAYRSGEVTPVQVAARFLAAVRESSGPGVSNMAFFISCDPDDVMRQAEESTLRYQRGAPLSALDGVLVGVKDEIDCLPYPTTGGTRWLGAARRCEADAACVAQLRACGAVLAGKANMHELGAGTSGINPHHGSTRNPYNASTIAGGSSSGSAAIVCAGLCPVALGVDGGGSVRMPAALCGVVGFKPTAGRLSNAGVLPLNWTVGMPGILAGTVEDALIAYSAIVDQSQPSYLRPELNLPQLGSTLSIGNIKLARYGKWFNDSAEDIRSCCDKALQALRANYGWQTVDVTIPEVEEMRLAHYVTIGSECTTSLAKYLDKLKRSEIGWDARVALSVYGSFSSRAYLNAQRLRNRQMYFHKQIFKAADVIVSPMTGVTAYPLQDDALSTGELDYINGAALVRYSIAGNFLGLPAITVTVGYDRGGLPIGLQFIGRPWAEATLLHVAFATQQACAKGYKKPPVFYDLLGKQQD

SEQ ID NO: 7605 - protein, 609 aa, Panicum virgatum
MGLFSSPAKVYKPAADVDLGPGSDEFYISPNVKAPRVAGLLVKIFVWILEMPIVGQIVLYILKKDNLINKLVSDADIPEPPLFTATHNWEDIPEQNVVLTKPDLSAAERVQEAVGCLPARLEATLAADAPLSGLKRWTIRDFYDAYSSGETTPVQVATRFLAAVKESSGPGLNMAFFISCDPEDVMRQAEESTLRYQRGAPLSALDGVLVAVKDEIDCAPYPTTGGTRWLAAARRCEADAACVAQLRACGAVLAGKANMHELGAGTSGINPHHGSARNPYNAGKIAGGSSSGSAAVVCAGLCPVALGVDGGGSVRMPAALCGVVGFKPTAGRLSSAGVLPLNWTVGMPGILAGTVEDALVAYSAIVDQSQPSYLRPELNLPQLKSSMSINNIKLAKYAKWFNDSAEDIRSCCDKALKTLQAHYGWQTVDVTIPEIEEMRLAHYVTIGSECTTSLAKYLDKLKRSEIGWDARVALSVYGSFSSRAYLNSQRIRNRQMYFHKEIFKTADVIVSPMTGVTAYTLQDDAFDTGELDYINGAALVRYSIAGNFLGLPAITVKVGYDKGGLPIGLQFIGRPWSEATLLHIAFAMQEACAKGYKKPAVFYDLLKKE

SEQ ID NO: 7606 - protein, 609 aa, Setaria italica
MGLFSSPAKVYKPAADVDLGPGSDEFYISPNVKAPRVAGLLVKIFVWILEMPIVGQIVLYILKKDNLINKLVSDADIPEPPLFTATHSWEDIPEQNVRLIKPDLSAAERVQEAAGCLPARLEATLAAGAASSGLKRWTIRDFADAYSSGETTPVQVATRFLAAVKESSGPDLNMAFFISCDPEDVMRQAEESTRRYQRGAALSALDGVLVAVKDEMDCVPYPTTGGTRWLAAARRCEADAACVAQLRACGAVLAGKANMHELGAGTSGINPQHGSARNPYNSNKIAGGSSSGSAAVVSAGLCPVALGVDGGGSVRMPAALCGIVGFKPTAGRLSNAGVLPLNWTVGMPGILAGTVEDALIAYSAIVDQSQPSYLRPELNLPQLKSTLSMSNIKLAKYAKWFNDSAEDIRSCCDKALKTLQAHYGWQTVDVTIPEIEEMRLAHYVTIGSECTTSLAKYLDKLKRSEIGWDARVALSVYGSFSSRAYLNSQRLRNRQMYFHKEIFKTADVIVSPMTGVTAYTLQDDAFNTGELDYINGAALVRYSIAGNFLGLPAITVMVGHDKGGLPIGLQFIGRPWSEATLLHIAFAMQEACAKGHKKPAVFYDLLKKE

SEQ ID NO: 7607 - protein, 589 aa, Setaria italica
PGSDEFYISPNVKAPRVAGLLVKIFVWILEMPIVGQIVLYILKKDNLINKLVSDADIPEPPLFTATHSWEDIPEQNVRLIKPDLSAAERVQEAAGCLPARLEATLAAGAASSGLKRWTIRDFADAYSSGETTPVQVATRFLAAVKESSGPDLNMAFFISCDPEDVMRQAEESTRRYQRGAALSALDGVLVAVKDEMDCVPYPTTGGTRWLAAARRCEADAACVAQLRACGAVLAGKANMHELGAGTSGINPQHGSARNPYNSNKIAGGSSSGSAAVVSAGLCPVALGVDGGGSVRMPAALCGIVGFKPTAGRLSNAGVLPLNWTVGMPGILAGTVEDALLAYSAIVDQSQPSYLRPELNLPQLKSTLSMSNIKLAKYAKWFNDSAEDIRSCCDKALKTLQAHYGWQTVDVTIPEIEEMRLAHYVTIGSECTTSLAKYLDKLKRSEIGWDARVALSVYGSFSSRAYLNSQRLRNRQMYFHKEIFKTADVIVSPMTGVTAYTLQDDAFNTGELDYINGAALVRYSIAGNFLGLPAITVMVGHDKGGLPIGLQFIGRPWSEATLLHIAFAMQEACAKGHKKPAVFYDLLKKE

SEQ ID NO: 7608 - protein, 605 aa, Avena sativa
MGVFSSSAKVYQPAAEVDLGPSSGELYISPNVKAPRVAGLLVKIFVWVLELPIVGWVLLYILKKDNLINKLVSEAEIPEPPLFTATHSWEDTPEQNVSLTKPDLSPAERVQEAVSCLPARLESTLTGDGLKRWTIRDFSKAYSSGETTPVQVAKRFLAAVKESSGPTLNMAFFINCDPGDVMKQAEESTLRYERGAPLSALDGVLVGVKDEIDCLPYPTTGGTRWLGKARPCDADAACVAQLRACGAVLAGKTNMHELGAGTSGINPHYGSARNPYNVGKVAGGSSSGSAAVVCAGLCPVALGVDGGGSVRMPAALCGVVGFKPTAGRLSGAGVLPLNWTVGMAGILAGTVEDAAIAYSAIVDQSQPSYLRPELNLPLLTSTPSISNVKLAKSAKWFNDSSDDIRTCCDKALQTLYTHYGWETVDVTVPEIEEMRLAHYVTIGSECTASLSKYLDKLKRSEIGWDVRVALGVYGSFSSRAYLNSQRLRNRQMFFHKEIFKTADVIVSPMTGVTAPALQDDARNTGELDYINGAALIRYSIAGNFLGLPAITVMVGQDKAGLPIGLQFIGRPWSEATLLHIAFAMQESCSKNHRKPAVFYDLLKKE

SEQ ID NO: 7609 - protein, 610 aa, Secale cereale
MGVFGSSAKVYRPAPEVDLGPGSGELYISPNVKAPRVAGLLVKIFVWVLEMPVVGWVLLYILKKDNLINKLVSEAEIPEPPLFTSTHRWEDTPEQNVSLTKPGLSPAERVREAVDCLPARLESTLAADAPPSSSLKRWTIMDFSRAYSSGETTPVQVAKRFLAAVKECSGPTMNMAFFISCNPEDVLKQAQESTLRYQTGTPLSVMDGVLVAVKDEIDCLPYPTTGGTRWLGKARPCEADAACVAQLRACGAVLAGKTNMHELGAGTSGINPHHGSARNPYNVGKVAGGSSSGSAAVVCAGLCPVALGVDGGGSVRMPAALCGVVGFKPTAGRLSNAGVLPLNWTVGMAGILAGTVEDAVVAYSAIVDQSQPSYLRPELNLPMLTSTPSISNVRLAKYGKWFNDSSEDIRTCCDKALQTLRAQYGWETLDVTVPEIEEMRLAHYVTIGSECTASLAKYLDKLKRSEIGWDVRVALAVYGSFSSRAYLNSQRLRNRQMFFHKEIFKTADVIVSPMTGVTAYTLQDDALNSGELDYINGAALIRYSIAGNFLGLPAITVMVGQDKGGLPIGLQFIGRPWSEATLLHIAFAMQEACSKNHRKPVVFYDLLKKD

SEQ ID NO: 7610 - protein, 603 aa, Oryza sativa
MAAKVYKPAAEVNLGPDSDEFYISPNVKAPRVAGLLVKIFVWILEMPIIGSMVLYILKKDNLINKLVQDAEIPEPPLFTSTHSWEDIPEQNVCLTKPDLSPPERVQEAVSCLPASLESTLAGSPPSSPKRWTIRDFNRAYSSGEVTPVQVAKRFLAAVKECSGPGLNMAFFISYSPEDIIRQAEESTLRYQRGTPLSAMDGILVAVKDEIDCLPYPTTGGTRWLGRARACAADAAVVAQLRACGAVLAGKTNMHELGAGTSGINPHHGSTRNPHNPGRVSGGSSSGSAAAVCAGLCPVALGVDGGGSVRMPAALCGVVGFKPTAGRLSNAGVLPLNWTVGMPGILAGTVEDAAVAYSAIVDQSQPSYLRPELNLPLLKSSLSIKNIKLAKYAKWFNDSSEDIRSCCDKSLQMLHAHYGWETLDVTIPEIEEMRLAHYVTIGSECTASLAKYLDKLKRSEIGWDVRVALGVYGSFSSRAYLNSQRLRNRQMYFHKEIFKTADVIVSPMTGVTAYKLQDDALKSGELDYINGAALVRYSIAGNFLGLPAITVMVGYDKAGLPIGLQFIGRPWSEATLLHIAFAMQEACKKHYKKPEVFYDLLKKD

SEQ ID NO: 7611 - protein, 610 aa, Triticum aestivum
MGLFGSSAKVYRPAPEVDLGPGSGELYISPNVKAPRVAGLLVKIFVWVLEMPVVGWVLLYILKKDNLINKLVSEAEIPEPPLFTSTHRWEDTPEQNVCLTKPGLSPAERVREAVDCLPTRLESTLAADVPPSSSLKRWTIMDFSRAYSSGETTPVQVAKRFLAAVKECSGPTMNMAFFISCDPEDVLKQAEESTLRYQTGTPLSVMDGVLVAVKDEIDCLPYPTTGGTRWLGKARPCEADAACVAQLRACGAVLAGKTNMHELGAGTSGINPHHGSARNPYNVGKVAGGSSSGSAAVVCAGLCPVALGVDGGGSVRMPAALCGVVGFKPTAGRLSNAGVLPLNWTVGMAGILAGTVEDAVVAYSAIVDQSQPSYLRPELNLPMLTSTPSISNVRLAKYGKWFNDSSEDIRTCCDKALQTLRAQYGWETLDVTVPEIEEMRLAHYVTIGSECTASLAKYLDKLKRSEIGWDVRVALAVYGSFSSRAYLNSQRLRNRQMFFHKEIFKTADVIVSPMTGVTAYTLQDDALSSGELDYINGAALIRYSIAGNFLGLPAITVMVGQDKGGLPIGLQFIGRPWSEATLLHIAFAMQEACSKNHRKPVVFYDLLKKD

SEQ ID NO: 7612 - protein, 606 aa, Brachypodium distachyon
MGIFGSAAKVYRPAAEVDLGPGSAEHYISPNVKAPRVAGLLVKIFGWVLELPVVGWFLLYILKKDNLINKLVSEAEIPEPPLFTSTHSWEDTPEQNVCLTKPDLSPAERVREAVGCLPARLESTLGAGPALKRWTIMDFHRAYSSGETTPVQVAKRFLAAVKESSGPTLNMAFFISCNPEDVLKQAEESTLRYQKGAALSALDGVLVAVKDEIDCMPYPTTGGTRWLGNARPCAADAACVAPLRACGAVLAGKANMHELGAGTSGINPHHGSARNPYDAGKVAGGSSSGSAAVVCAGLCPVALGVDGGGSVRMPAALCGVVGFKPTAGRLSSAGVLPLNWTVGMAGILAGTVEDALVAYSAIVDHSQPSYMRPELNLPMLTSTPSISNVKLAKYAKWFNDSSDDIRSCCDKALQTLRTHYGWETLDVTVPEIEEMRLAHYVTIGSECTASLAKYLDKLKRSEIGWDVRVALAVYGSFSSRAYLNSQRIRNRQMFFHKEIFKTADVIVSPMTGVTAYTLQDDALQSGELDYINGAALIRYSIAGNFLGLPAITVMVGQDKGGLPIGLQFIGRPWSEATLLHIAFAMQEACSKNHRKPAVFYDLLKKD

SEQ ID NO: 7613 - protein, 658 aa, Setaria italica
MVKIEDLTEDSSADADARVPREAAVGLLPGSVHASLKEEDQPSSSSSSLRLQFIGMGFSPKLVDKVLKRHGDDDSNTILESLLSYSDLQQSGSESSGSLGSLFDSDNEENNSPLESMKGIGQDIKPEPDSFSEKWSYLLQTMKFSQQEVDLAFKKLGDEAPLEQLVNCIVNAQLGGSSGGLENGDTTNEGKAEALFGIMEKTLSLLQKGYTEEEVSSAIDSFGHRATVQVLEDSILARRIANSIEQKEIKVESDFLGEAETDYSTYQTSYSAVRCYDDDVNNTRVKRAKHIFMNDRGASSSNPANPWSMGRCAGTSDMPVKVELEAVTPGCRAKVQGDLAKPPYFLYGNVVEIPKDTWHQLKQFLYNVEPEFVSSQFFSALTRKEGYIHNLPVEGRHVVVPKSPMTIEEALPFTRQWWPSWDTRKHISVVTIEAAGIDQTCERLGRMVRESRGVLSQERQMQIMHQCTVSNLIWVGRDKLSPLEPRQLERILGYPHNHTNLFELNQSDRFAAMRYAFQTDTLSYFLSVLKDQFPHGIRVLSIYSGIGGAEVTLHRLGIPLKCVVSVEESEVNRKILKRWWLKTEQTGELRQLPGIWKLKIQVIEDFITEFGGFDLIIGGNYTSCKGGTTVNTTMGMDSNRFYEYARVVKRVRAAVGVN

SEQ ID NO: 7614 - protein, 557 aa, Zea mays
MQHDQKKKAPSEMDFFTEYGEGSRYKIEEVIGKGSYGVVCSAVDTHTGEKVAIKKINDIFEHVSDATRILREIKLLRLLRHPDIVEIKHILLPPSRREFRDIYVVFELMESDLHQVIKANDDLTPEHYQFFLYQLLRGLKYIHTANVFHRDLKPKNILANADCKLKICDFGLARVAFNDTPTAIFWTDYVATRWYRAPELCGSFFSKYTPAIDIWSIGCIFAELLTGKPLFPGKNVVHQLDIITDLLGTPSPEAISRIRNEKARRYLSSMRRKKPIPFTQKFPNADPLALCLLERMLAFEPKDRPSAEEALADPYFKNIASVDREPSAQAVTKLEFEFERRRVTKEDIRELIYREILEYHPKMLREFLEGTESSGFMYPSAVDHFKKQFAYLEEHYAKGSTGTPPERQHNSLPRPSVVYSDNRSQTTANITEDLSKCMLRENTQKTHPYSASVASKFPPHVPQGDVARPGKAVGSVMQYSPCPAPAAERYEQRRIARHPAVAPNNIPSGSSYPRRSQTCKSETGDAESHMDANQARQPKPYAANKLPATVDSRGGHW

SEQ ID NO: 7615 - protein, 557 aa, Setaria italica
MQHDQKKKAPSEMDFFTEYGEGSRYKIEEVIGKGSYGVVCSALDTHTGEKVAIKKINDIFEHVSDATRILREIKLLRLLRHPDIVEIKHILLPPSRREFRDIYVVFELMESDLHQVIKANDDLTPEHYQFFLYQLLRGLKYIHTANVFHRDLKPKNILANADCKLKICDFGLARVAFNDTPTAIFWTDYVATRWYRAPELCGSFFSKYTPAIDIWSIGCIFAELLTGKPLFPGKNVVHQLDIITDLLGTPSPEAISRIRNEKARRYLSTMRRKKAIPFTQKFPNADPLALSLLERMLAFEPKDRPSAEEALADPYFKNIANVDREPSAQAVTKLEFEFERRRVTKDDIRELIYREILEYHPKMLREFLEGTESSGFMYPSAVDHFKKQFAYLEEHYCKGSTGTPPERQHNSLPRPSVVYSDNRQQSTANITEDLSKCLIRENTQKTQQHSASVAANKFPLHVPHGAAARPGKAVGSVLQYNPGPASAAEQYEQRRIARHPAIAPNNIPSGSSYPRRNQTCKSETGDAERMDVNQAGQPKPYAANKLPATVDGRGGHW

SEQ ID NO: 7616 - protein, 557 aa, Panicum virgatum
MQHDLKKKGPSEMDFFTEYGEGSRYKIEEVIGKGSYGVVCSAMDTHTGEKVAIKKINDIFEHVSDATRILREIKLLRLLRHPDIVEIKHILLPPSRREFRDIYVVFELMESDLHQVIKANDDLTPEHYQFFLYQLLRGLKYIHTANVFHRDLKPKNILANADCKLKICDFGLARVAFNDTPTAIFWTDYVATRWYRAPELCGSFFSKYTPAIDIWSIGCIFAELLTGKPLFPGKNVVHQLDIITDLLGTPSPEAISRIRNEKARRYLSSMRRKKPIPFTQKFPNADPLALNLLERMLAFEPKDRPSAEEALADPYFKNIANVDREPSAQAVTKLEFEFERRRVTKDDIRELIYREILEYHPKMLREFLEGTESSGFMYPSAVDHFKKQFAFLEEHYAKGSTGTPPERQHNSLPRPSVVYSDNRQQSTANITEDLSKCLIRENTQKTQQHSASEAANKFPLHVTHGAATRPGKAVGSVLQYNPGPASAAEQYDQRRVARHPAIAPNNIPSGSSYPRRNQTCKGETGDPERMDVNQAGQPKPYAANKLPATVDGRGGHW

SEQ ID NO: 7617 - protein, 545 aa, Setaria italica
MDFFTEYGEGSRYKIEEVIGKGSYGVVCSALDTHTGEKVAIKKINDIFEHVSDATRILREIKLLRLLRHPDIVEIKHILLPPSRREFRDIYVVFELMESDLHQVIKANDDLTPEHYQFFLYQLLRGLKYIHTANVFHRDLKPKNILANADCKLKICDFGLARVAFNDTPTAIFWTDYVATRWYRAPELCGSFFSKYTPAIDIWSIGCIFAELLTGKPLFPGKNVVHQLDIITDLLGTPSPEAISRIRNEKARRYLSTMRRKKAIPFTQKFPNADPLALSLLERMLAFEPKDRPSAEEALADPYFKNIANVDREPSAQAVTKLEFEFERRRVTKDDIRELIYREILEYHPKMLREFLEGTESSGFMYPSAVDHFKKQFAYLEEHYCKGSTGTPPERQHNSLPRPSVVYSDNRQQSTANITEDLSKCLIRENTQKTQQHSASVAANKFPLHVPHGAAARPGKAVGSVLQYNPGPASAAEQYEQRRIARHPAIAPNNIPSGSSYPRRNQTCKSETGDAERMDVNQAGQPKPYAANKLPATVDGRGGHW

SEQ ID NO: 7618 - protein, 545 aa, Pennisetum glaucum
MDFFTEYGEGSRYKIEEVIGKGSYGVVCSALDTHTGEKVAIKKINDIFEHVSDATRILREIKLLRLLRHPDIVEIKHILLPPSRREFRDIYVVFELMESDLHQVIKANDDLTPEHYQFFLYQLLRGLKYIHTANVFHRDLKPKNILANADCKLKICDFGLARVAFNDTPTAIFWTDYVATRWYRAPELCGSFFSKYTPAIDIWSIGCIFAELLTGKPLFPGKNVVHQLDIITDLLGTPSPEAISRIRNEKARRYLSTMRRKKATPFTQKFPNADPLALSLLERMLAFEPKDRPSAEEALADPYFKNIANVDREPSAQAVTKLEFEFERRRVTKDDIRELIYREILEYHPNMLREYLEGTESSGFMYPSAVDHFKKQFTYLEEHYAQGSTGTPPERQHNSLPRPAVVYSDNRQQSTANITEDLSKCLIRENTQKTQQHSAPVAASKFPLHVPHGAAARPGKAVGSVLQYNPGPASAAEQYEQRRVARHPAIAPNNIPSGSSYPRRNQTCKSETGDAERMDVNQAGQPKPYAANKLPATVDGRGGYW

SEQ ID NO: 7619 - protein, 544 aa, Zea mays
MDFFTEYGEGSRYKIEEVIGKGSYGVVCSALDTHTGEKVAIKKINDIFEHVSDATRILREIKLLRLLRHPDIVEIKHILLPPSRREFRDIYVVFELMESDLHQVIKANDDLTPEHYQFFLYQLLRGLKYIHTANVFHRDLKPKNILANADCKLKICDFGLARVAFSDTPTAIFWTDYVATRWYRAPELCGSFFSKYTPAIDIWSIGCIFAELLTGKPLFPGKNVVHQLDIITDLMGTPSPEAISRIRNEKARRYLSNMRRKKPIPFTQKFPNADPLALGLLERMLAFEPKDRPSAEEALAHPYFKNIANVDREPSAQAVTKLEFEFERRRVTKDDIRELIYREILEYHPKMLKEFIEGTESSGFMYPSAVDNFKKQFAYLEEHYAKGSTGTPPERQHNSLPRPSVVYSDNQSQSTANITEDLSKCIIRENAQKSQQYNASVANKFPSHVPQGAAARPGKAVGSVLQYNLSQASAAEQYEQRRVARHPAVAPNNIPSGSSYPRRNQTCKSETGDTERMDVNQAGQPKSYAANKLPATVDGRGGHW

SEQ ID NO: 7620 - protein, 542 aa, Oryza sativa
MDFFTEYGEGNRYKIEEVIGKGSYGVVCSALDTHTGDKVAIKKINDIFEHVSDATRILREIKLLRLLRHPDIVEIKHILLPPSRREFKDIYVVFELMESDLHQVIKANDDLTPEHYQFFLYQLLRGLKYIHTANVFHRDLKPKNILANADCKLKICDFGLARVAFSDTPTAIFWTDYIATRWYRAPELCGSFFSKYTPAIDIWSIGCIFAELLTGKPLFPGKNVVHQLDIITDLLGTPSPETISRIRNEKARRYLNSMRRKKPIPFTQKFPNADPLAMRLLERMLAFDPKDRPSAEEALADPYFKNIANVDREPSAQPITKLEFEFERRRITKEDIRELIYREILEYHPKMLREFLEGTESTGFMYPSAVDHFKKQFAYLEEHYAKGSTAAPPERQHNSLPRPCVVYSDNRPQSTASVTEDLSRCLIRDNNLKSQDSASVGASRIPQGAAARPGKAVGSVLRYGNCSTSAAEQQYEQRRVVRNPAIAPNSSVPLGSSYPRRNQTCKSETGDVERIDSSQTGPPKPYVANKLPATVDGRSGHW

SEQ ID NO: 7621 - protein, 498 aa, Oryza sativa
MDFFTEYGEGNRYKIEEVIGKGSYGVVCSALDTHTGEKVAIKKINDIFEHVSDATRILREIKLLRLLRHPDIVEIKHILLPPSRREFKDIYVVFELMESDLHQVIKANDDLTPEHYQFFLYQLLRGLKYIHTANVFHRDLKPKNILANADCKLKICDFGLARVAFSDTPTAIFWTDYVATRWYRAPELCGSFFSKYTPAIDIWSIGCIFAELLTGKPLFPGKNVVHQLDIITDLLGTPSTEAISRIRNEKARRYLSSMRRKKPIPFTQKFPNADPLALRLLERMLSFEPKDRPNAEEALADPYFRNIANVDREPSAQPVTKLEFEFERRRITKEDIRELIYRDILEYHPNMLREYLEGTESAGFMYPSAVDHFKKQFAYLEEHYAKGSTAAPPERQHNSLPRPSVLYSDDRPQNTANIAEDLSKCVLGDNTQKMHQGSASVCANRVPQGGAARPGKVVGSALRYGNCSTSTAEQYEHRRTDRNPALATNTVSPRGSYP

SEQ ID NO: 7622 - protein, 544 aa, Brachypodium distachyon
MDFFTEYGEGNRYKIEEVIGKGSYGVVCSALDTHTGDKVAIKKINDIFEHVSDATRILREIKLLRLLRHPDIVEIKHILLPPSRREFKDIYVVFELMESDLHQVIKANDDLTPEHYQFFLYQLLRGLKYIHTANVFHRDLKPKNILANADCKLKICDFGLARVAISDTPTAIFWTDYIATRWYRAPELCGSFFSKYTPAIDIWSIGCIFAELLTGKPLFPGKNVVHQLDIITDLLGTPSAETIARIRNEKARRYLSSMRRKKTVPFTQKFPNADPLALNLLERMLAFDPKDRPSAEEALADPYFKNIASVDREPSAQPITKLEFEFERRRITKDDIRELIYREILEYHPNMLREFLEGAEPTGFMYPSAVDHFKKQFTFLEEHYAKGSTAAPPERQHNSLPRPSVIYSDNRPQNAANITDDLSRCAIRDNTQKAQKDSASVGANRIPHGAAAAAARPGKVVGSVLRYGNCSTSGTEQYEQRRVVRSPGIAPNGVTSGSSYPRRNNTCKSETGEAERIDTNQGGPPKPYVANKLPATVDGRNGHW

SEQ ID NO: 7623 - protein, 534 aa, Setaria italica
MDFFTEYGEGNRYKIEEVIGKGSYGVVCSALDTHTGEKVAIKKINDIFEHVSDATRILREIKLLRLLRHPDIVEIKHILLPPSRREFKDIYVVFELMESDLHQVIKANDDLTPEHYQFFLYQLLRGLKYIHTANVFHRDLKPKNILANADCKLKICDFGLARVAFSDTPTAIFWTDYVATRWYRAPELCGSFFSKYTPAIDIWSIGCIFAELLTGKPLFPGKNVVHQLDIITDLLGTPSPEAISRIRNEKAKRYLSSMRRKKPIPFTHKFPNADPLALRLLERMLAFDPKDRPSAEEALADPYFKNIANVDREPAAQPVMKLEFEFERRRITKEDIRELIYREILEYHPNMLREFLEGTESTGFMYPSAVDHFKKQFAYLEEHYAKGSTAAPPERQHNSLPRPSVLYSDNRTQSTTNVTEDLSKCVIRDDARRAQLDSSSVGANRVPQGGATRPARGVGSAERYGNYASPAADQYEQRRIANGVSPRSSYPKRIPTCKGETSEADRIDVRQTGQPKPYIPNKLPTTVDGRNGHW

SEQ ID NO: 7624 - protein, 549 aa, Hordeum vulgare
MDFFTEYGEGNRYKIEEVIGKGSYGVVCSALDTHTGEKVAIKKINDIFEHVSDATRILREIKLLRLLRHPDIVEIKHILLPPSRREFKDIYVVFELMESDLHQVIKANDDLTPEHYQFFLYQLLRGLKYIHTANVFHRDLKPKNILANADCKLKICDFGLARVAISDTPTAIFWTDYIATRWYRAPELCGSFFSKYTPAIDIWSIGCIFAELLTGKPLFPGKNVVHQLDIITDLLGTPSPETIARIRNEKARRYLSSMRRKKPVPFTQKFPNADPLALNLLERMLAFDPKDRPSAEEALADLYFKNIASVDREPSAQPITKLEFEFERRRITKDDIRELIYREILEYHPNMLREFLEGAEPTGFMYPSAVDHFKKQFTFLEEHYAKGSTAAPPERQHNSLPRPSVIFSDNRPQGSDSRPQGAANITDDLSRCIIRDNTQKPRRDTASVGANRVPQGAAVARPGKVVGSALRYGNCSTSGTEQYEQRRVITGQGIVPNGVPSGSSYPRRNNTCKSETGEAERIDVSQAGPPKPYTGNKLPATVDGRNGHW

SEQ ID NO: 7625 - protein, 369 aa, Secale cereale
MDFFTEYGEGNRYKIEEVIGKGSYGVVCSALDTHTGEKVAIKKINDIFEHVSDATRILREIKLLRLLRHPDIVEIKHILLPPSRREFKDIYVVFELMESDLHQVIKANDDLTPEHYQFFLYQLLRGLKYIHTANVFHRDLKPKNILANADCKLKICDFGLARVAISDTPTAIFWTDYIATRWYRAPELCGSFFSKYTPAIDIWSIGCIFAELLTGKPLFPGKNVVHQLDIITDLLGTPAPETIARIRNEKARRYLSSMRRKKLVPFTQKFPNADPLALNLLERMLAFDPKDRPSAEEALADLYFKNIASVDREPSAQPITKLEFEFERRRITKDDIRELIYREILEYHPNMLREFLEGPSQLISCTQVQ

SEQ ID NO: 7626 - protein, 549 aa, Triticum aestivum
MDFFTEYGEGNRYKIEEVIGKGSYGVVCSALDTHTGEKVAIKKINDIFEHVSDATRILREIKLLRLLRHPDIVEIKHILLPPSRREFKDIYVVFELMESDLHQVIKANDDLTPEHYQFFLYQLLRGLKYIHTANVFHRDLKPKNILANADCKLKICDFGLARVAISDTPTAIFWTDYIATRWYRAPELCGSFFSKYTPAIDIWSIGCIFAELLTGKPLFPGKNVVHQLDIITDLLGTPAPETIARIRNEKARRYLSSMRRKKPVPFTQKFPNADPLALNLLERMLAFDPKDRPSAEEALADLYFKNIASVDREPSAQPITKLEFEFERRRITKDDIRELIYREILEYHPNMLREFLEGAEPTNFMYPSAVDHFKKQFTFLEEHYAKGSTAAPPERQHNSLPRPSVIYSDNRPQGSDSRPQGAANITDDLSRCIIRDNTQKPRRDPASVGANRVPQGAAVARPGKVVGSALRYGNCSTPGTEQYEQRRVITSQGVVPNGVPSGSSYPRRNNTCKSETGEAERIDVSQAGPPKPYTGNKLPATVDGRNGHW

SEQ ID NO: 7627 - protein, 549 aa, Secale cereale
MDFFTEYGEGNRYKIEEVIGKGSYGVVCSALDTHTGEKVAIKKINDIFEHVSDATRILREIKLLRLLRHPDIVEIKHILLPPSRREFKDIYVVFELMESDLHQVIKANDDLTPEHYQFFLYQLLRGLKYIHTANVFHRDLKPKNILANADCKLKICDFGLARVAISDTPTAIFWTDYIATRWYRAPELCGSFFSKYTPAIDIWSIGCIFAELLTGKPLFPGKNVVHQLDIITDLLGTPAPETIARIRNEKARRYLSSMRRKKLVPFTQKFPNADPLALNLLERMLAFDPKDRPSAEEALADLYFKNIASVDREPSAQPITKLEFEFERRRITKDDIRELIYREILEYHPNMLREFLEGAEPTNFMYPSAVDHFKKQFTFLEEHYAKGSTAAPPERQHNSLPRPSVIYSDNRPQGSDSRPQGAANITDDLSRCIIRDNAQKPRRDPASVGANRVPQGAAVARPGKVVGSALRYGNCSTSGTEQYEQRRVITSQGIVPNGVPSGSSYPRRNNTCKSETGEAERIDVSQAGPPKPYTGNKLPATVDGRNGHW

SEQ ID NO: 7628 - protein, 549 aa, Secale cereale
MDFFTEYGEGNRYKIEEVIGKGSYGVVCSALDTHTGEKVAIKKINDIFEHVSDATRILREIKLLRLLRHPDIVEIKHILLPPSRREFKDIYVVFELMESDLHQVIKANDDLTPEHYQFFLYQLLRGLKYIHTANVFHRDLKPKNILANADCKLKICDFGLARVAISDTPTAIFWTDYIATRWYRAPELCGSFFSKYTPAIDIWSIGCIFAELLTGKPLFPGKNVVHQLDIITDLLGTPAPETIARIRNEKARRYLSSMRRKKLVPFTQKFPNADPLALNLLERMLAFDPKDRPSAEEALADLYFKNIASVDREPSAQPITKLEFEFERRRITKDDIRELIYREILEYHPNMLREFLEGAEPTNFMYPSAVDHFKKQFTFLEEHYAKGSTAAPPERQHNSLPRPSVIYSDNRPQGSDSRPQGAANITDDLSRCIIRDNAQKPRRDPASVGANRVPQGAAVARPGKVVGSALRYGNCSTSGTEQYEQRRVITSQGIVPNGVPSGSSYPRRNNTCKSETGEAERIDASQAGPPKPYTGNKLPATVDGRNGHW

SEQ ID NO: 7629 - protein, 540 aa, Sorghum bicolor
MDFFTEYGEGSRYKIEEVIGKGSYGVVCSALDTHTGEKVAIKKINEIFEHVSDATRILREIKLLRLLRHPDIVEIKHILLPPSRREFKDIYVVFELMESDLHQVIKANDDLTPEHYQFFLYQLLRGLKYIHTANVFHRDLKPKNILANADCKLKICDFGLARVAFNDTPTAIFWTDYVATRWYRAPELCGSFFSKYTPAIDIWSIGCIFAELLTGKPLFPGKNVVHQLDIITDLLGTPSPEAISRIRNEKAKRYLSSMRRKRPIPLTQKFPNADPLALRLLEKMLAFDPKDRPSAEEALADPYFKNIANVDREPSAQPVTKLEFEFERRRITKEDIRELIYREILEYHPNMLREFLEGTESTGFMYPSAVDHFKKQFAYLEEHYAKGSTAAPPERQHNSLPRPCVLYSDNLTKSTANVMEDLSKCVIRDETQRGQLDSSSIGANRVPQGGASRPARVVGSAMRYGNSSSSGTYQYEQRTAKNPAIGATGVSPRGSYSRTIPTCKSETSEADRIDASQTRQPKPYIPNKLPTTVDGRNGHW

SEQ ID NO: 7630 - protein, 549 aa, Triticum aestivum
MDFFTEYGEGNRYKIEEVIGKGSYGVVCSALDTHTGEKVAIKKINDIFEHVSDATRILREIKLLRLLRHPDIVEIKHILLPPSRREFKDIYVVFELMESDLHQVIKANDDLTPEHYQFFLYQLLRGLKYIHTANVFHRDLKPKNILANADCKLKICDFGLARVAISDTPTAIFWTDYIATRWYRAPELCGSFFSKYTPAIDIWSIGCIFAELLTGKPLFPGKNVVHQLDIITDLLGTPAPETIARIRNEKARRYLSSMRRKKPVPFTQKFPNADPLALNLLERMLAFDPKYRPSAEEALADLYFKNIASVDREPSAQPITKLEFEFERRRITKDDIRELIYREILEYHPNMLREFLEGAEPTNFMYPSAVDHFKKQFTFLEEHYAKGSTAAPPERQHNSLPRPSVIYSDNRPQGSDSRPQGAANITDDLSRCIIRDNAQKPRRDPASVGANRVPKGAAVARPGKVVGSALRYGNCSTSGTEQYEQRRVITSQGIVPNGVPSGSSYPRRNNTCKSETGEAERIDVSQAVPPKPYTGNKLPATVDGRNGHW

SEQ ID NO: 7631 - protein, 549 aa, Triticum aestivum
MDFFTEYGEGNRYKIEEVIGKGSYGVVCSALDTHTGEKVAIKKINDIFEHVSDATRILREIKLLRILRHPDIVEIKHILLPPSRREFKDIYVVFELMESDLHQVIKANDDLTPEHYQFFLYQLLRGLKYIHTANVFHRDLKPKNILANADCKLKICDFGLARVAISDTPTAIFWTDYIATRWYRAPELCGSFFSKYTPAIDIWSIGCIFAELLTGKPLFPGKNVVRQLDIITDLLGTPAPETIATIPNEKARRYLSSMMRKKPVPFTHKFPNADPLALNLLERMLAFDPKDRPSAEEALADLYFKNIASVDREPSAQPITKLEFEFERRRITKDDIRELIYREILEYHPNMLREFLEGAEPTNFMYPSAVDHFKKQFTFLEEHYAKGSTAAPPERQHNSLPRPSVIYSDNRPQCSDSRPQGAANITDDLSRCIIRDNAQKPRRDPASVGANRVPQGAAVARPGKVVGSALRYGNCSTSGTEQYEQRRVVTSQGIVPNGVPSGSSYPRRNNTCKSETGEAERIDVSQAGPPKPYTGNKLAATVDGRNGHW

SEQ ID NO: 7632 - protein, 428 aa, Zea mays
SSVFLLLLSPAATSQLGQGPAIAAWINGSPPPSPDAAAAAAAAASGPRSQEYAALQALKVAVTDDPKGALASWQGANVCAYKGVYCSAPPDGAAAAGASTVVAGIDLNRANLRGTLPDAVSLLAHLTFLHLNSNRLGGAVPDTLRDLQYLTELDLSNNLFSGPFPASTLLIPSLVYLDLRFNAFSGEVPPEVFAKELDAVFLNDNQFEGQIPDTLWASPATVITLANNHFTGAVPAAYEFGAGAGAGAGGRVREVLFLNNNLTGCVPEALGFLPSMQVLDLSYNALSGHLPGTLSCLSGIEVLNLAHNQLTGELPDLLCDLRRITNLSVSFNFFSGISQRCDRQLGSRGVFDFVGNCVPGRDMQRPQPECDEFPGEGGLSCLRIPGARPAGCGDAGVTIGVGVGVGIGGLPFGLPGAAAGGVVTVTVP

SEQ ID NO: 7633 - protein, 438 aa, Setaria italica
MRRRPPFHSRAAAAVLLLLVLLTPAPTSQLGLGPAIAAWINGAPPPSPSPAAAGASSSSAPSQEYTALQALKAAVTEDPRGALSSWQGANVCAYRGVYCSAPPDGAAAAGAPTVVAGIDLNRANLRGTLPEAVSLLAHLTFLHLNSNRLGGAVPDSLRDLEYLTELDLSNNLFSGPFPSSTLLIPSLVYLDLRFNGFSGELPPEVFAKDLDALFLNDNQFEGQIPDTLWSSPATVITLANNHLTGPVPASYGYAGGRVREVLFLNNNLTGCVPEALGFLPSIQVLDLSYNALSGHLPGTLSCLSGIEVLNVAHNQLTGELPDLLCGLRRITNLSVAFNFFSGIGQRCDRQLGSRGVFDFVGNCVPGRDMQRPQPECDGFPGEGGLSCLRIPGARPAGCGDAAVSVGVGVGVGVGVGGVPFGLPGAAAGAGGVVTVTVP

SEQ ID NO: 7634 - protein, 314 aa, Setaria italica
MRRRPPFHSRAAAAVLLLLVLLTPAPTSQLGLGPAIAAWINGAPPPSPSPAAAGASSSSAPNQEYTALQALKAAVTEDPRGALSSWQGANVCAYRGVYCSAPPDGAAAAGAPTVVAGIDLNRANLRGTLPEAVSLLAHLTFLHLNSNRLGGAVPDSLRDLEYLTELDLSNNLFSGPFPSSTLLIPSLVYLDLRFNGFSGELPPEVFAKDLDALFLNDNQFEGQIPDTLWSSPATVITLANNHLTGPVPASYGYAGGRVREVLFLNNNLTGCVPEALGFLPSIQVLDLSYNALSGHLPGTRAYRGSRCSTWRTTS

SEQ ID NO: 7635 - protein, 670 aa, Zea mays
MMSDAWPSSPYSSSAPDGEVLRSLHRLARDLSAAEAPAPFLRPVFAAVARRARLLAAVFDDLLLCGAAAGPLLLLLLPRSASLCLRELLLVLQRFKALVADCATRSRTRLLLQSDEVAARARELQHDLATLIDLLPAAELGLADDVSDLLALASRQCRRAAAPELELKAGVLALIQEVEREIVPERERLEGILEDVGINDPASCSDEIETLEREIGDRVAERWTSSMIALVGLLRYAKCVLFSAATPRPVDSKVDLDDAEPPSPPPDFRCPISLELMGDPVVASSGQTYDRDSITRWFGSGKSTCPKTGQVLLNLELVPNKALKNLISRWCRENGIPMESSESGKAEPAPAVGANKAALKAARMTASFLVKKLSASFSPEATKRVVQEIRQLAKSGSDNRAFIGEAGAAGLLVPLLLSEDSALQLNAVTALLNLSILEANKKRIMHAEGAVDALCHVMGTGATWRAKENAAATVLSLAAVHAYRRRLGRNPRVVESVVRLARTGPSSTKKDALAALLCLSAERENVPRIVEAGAAEAALAAVGEAEAEAAAAVLASLAKRGGAEAIVALDGAVARLVNEMRRGTEWSRECAAAALVLLCRRAGAAAASQVVAVQGVEWAIWELLGTGTERARRKAASLGRACRRWAAAANAEQSTECPASADAPALTSAA

SEQ ID NO: 7636 - protein, 673 aa, Setaria italica
MASSATIDAWPSSPYSSSAPDGEVLRSLHRLARDLSAAEAPAPFLRPIFASVARRARLLAAVFDDLLLSGAAAEPLLLLPRSASLCLREVLLVLQRFKALVADCAARSRMRLLLQSDEVASRARELQQDLATLLDLLPVADLGLADDVADLLALASRQCRRVAAAELELKAGVLALIQEVEREIVPERERLEGILEEVGINDPASCSDEIETLEREIGERVAERWTSSMIALVGLLRYAKCVLFSAATPRPADFKVDLDDDDGAEPPSPPLDFRCPVSLELMSDPVVASSGQTYDRDSIARWFGSGKSTCPKTGQVLTNLELVPNKALKNLIARWCRENGIAVEVSEAGKADPAPVVAANKAALKAARMTASFLVKKLSASFSPESTKRVVHEIRQLAKSGSDNRAFIGEAGAAALLVPLLRSEDSALQLHAVTALLNLSILEANKKRIMHAEGAVDALCHVMCSGASWRAKENAAATVLSLATIHTYRRRLGRNPRVVDSVVQLARTGPSSTKKDALAALLSLSGERENIGRLVEAGAAEAAVAAIGEAEAAAAVLASLAKRGGAEAIVGIDGAVARLVAEMRRGTEWSRECAAAALVLLCRRSGAKAAAQVMAVAGVEWAIWELLGTGTDRARRKAASLGRACRRWAAAGAEQSTTVCPTSGAAPALTMAS

SEQ ID NO: 7637 - protein, 680 aa, Brachypodium distachyon
MANARNAAAAGSPSSSSSSYSSSAPDAEILRSLHRLARDLAAAEAPAPFLRAVFASVSRRAKLLVAVFDDLLGVVGRLPRSASLCLREVLLVLQRFKAVVADCSARSRMRLLLQSDEVAARVRELQHDLATLLDILPAATELGLADDVADLLALASRQCRRPAPEAAAEQELKASVLRLIQEVEQEIVPERERLEAILDEVDINDPASCSEEIEILEREIGDRLAERWTPAMIALVGLLRYAKCVLFSAATPRPLDSKADLGDGDDDGAEPPAPPLDFRCPISLDLMRDPVVSASGQTYDRESITRWFGSGKSTCPKTGQVLTSLELVPNKALKNLISRWCRENGVAMEGSEPGKPEPAPLATANKAAVEAARMTASFLVKKLTASFSPASDNRVVHEIRQLAKSGTESRAFIGEAGAIPLLVPMLQSEDAALQLNAVTALLNLSILEANKKRIMHAEGAVAALCHVMGSGATWRAKENAAAAVLSLSAVHSYRRRLGRNPRVVEKVLLLVRTGPASTKKDALAALLCLSGERENVGKLVGAGAVEAALSAIGEEETAAAVLASLAKRGGAEAIVNVDGAVARLVAEMRRGGTDWSRECAAAALVLLCRRAGAAAVAQVMAIPGVEWAIWELMGSGSERARRKAASLGRACRRWAVANAEQTTECPTNSTTVTLPVMAAS

SEQ ID NO: 7638 - protein, 670 aa, Secale cereale
MASARNAAASSSPYSSSAPDVDILRSLRRLARDLAAADPPAPFLRAVFASVSRRARLLVAVFDDLLLALGAGAGMPRSASLCLREVLLVLQRFKAVVADCSARSRMRLLLQSDEVAARVRELQHDLATLLDILPVGELGLADDVADLLTLASRQCRRRAPEAAAEQELKASVLALIQEVEREIVPERERLEAILEEVAINDPAGCSQEIEILEREIGDRLAERWTSAMIALVGLLRYAKCVLFSAATPRPLDSKVDADDDDAEPPAPPPDFRCPISLDLMRDPVVSSSGQTYDRESITRWFGAGKSTCPKTGQVLTNLELVPNKALKNLISRWCRENGVAMEGSEPGKPEPAPPVAANKAAVEAARMTASFLVKKLSASFSPGSDNRVVHEIRLLAKSGSESRAFIGEAGAVPLLVPLLNSEDAALQLNAVTALLNLSILDANKKRIMHTDGAVAALCGVMGSGATWRAKENAAATVLSLSAVHTYRRRLGRNPLVIEKVVLLVRTGPPSTKKDALAALLCLSAERENVSKLVGAGAAEAALSAIGEEDTAAAVLASLAKRGGAEAIVNIEGAVAKLVAEMRRGTEWSRECAAAALVLLCRRAGAAAASQVLAINGVEWAIWELMGSGSERARRKAASLGRTCRRWAAANAAQNADCPASTVSPPTVAAS

SEQ ID NO: 7639 - protein, 476 aa, Sorghum bicolor
MKKTVVLYPGLAVSHFVPMVQVADVLLEEGYDVVVAFIDPTLKGDIALAAVIDSVAASKPSVVFHKLPRVEDAPTFVHDSKFVVRYLEFVGRYCQHFHDFLFSMPPGSVHAVLVDVMSTEVLGVTSKLGIPAYAFFPSNASALAVFVQASSVRSEGQPSFRELGDAPLNFHGVPTMPASHLTAEMLEGPGSETFKTTMNMKSRIQKANGILVNTSASIEPRAVSALGDPRRLPKMPPVYCVGPLVAGNGGQATDKHECLAWLDEQPEQSVVFLCFGSTGASNHSEQQLKEIANGLERAGHRFLWVVRAPPHDDPEKPFDPRADPDLDALLPAGFLERTGGRGRVVKLWAPQVDVLHHAATGAFVTHCGWNSVLEGIVAGVPMLCWPLYAEQKMNKVFMVEEYGVAVEMVGWQQGLVKAEEVEAKVRLVMESEEGKLLRAQVSEHKEGAAMAWKDGGSSRAAFAQFLSHAGSVSGRA

SEQ ID NO: 7640 - protein, 390 aa, Zea mays
MGVGKLMNDVKPYLAMVLLQVGFSGMYIVSVASLKRGMNHFVLVVYRNLVATVVLAPFALLFERRVRPKMTPLIFLKIMGLAVLEPVLDQNMYYLGAKLTSATFASALVNILPAITFLMALVLRMERLRLRSLRSQAKVAGTVCTVVGAVLMILYHGPVVPFPWSAGHHQASAAAAAAAAESQSSASWLNGIVMIIGSCLCWSGFFVLQSNTLQSYPAELTLATLICFLGSVLTGGVALVAERHDMSAWVIGFDTRLFTAVYSGIVCSGVAFYVQGIVTQARGPVFVTAFQPLCMIITTVLGSTILKEETTLGSVIGAAIIVVGLYCLIWGKSKDHLGNGGKPAVAELPLTSAPNGGTNGYGKHALGGGGGGHHVAAGVEAPPPSSKCVH

SEQ ID NO: 7641 - protein, 353 aa, Saccharum officinarum
MGVGKLMNDVKPYLAMVLLQVGFSGMYIVSVASLKRGMNHFVLVVYRNLVATVVMAPFALIFERGVRPKMTPRIFLKIMGLAVLEPVLDQNMYYIGAKLTSATFASALVNILPAITFLMALVMRMEKLRLRSLRSQAKVVGTVCTVAGAVLMILYHGPVVPFPWSAGHHHAGAAAAAAESQSSASWLGTVMIIGSCLCWSGFFILQSNTLQSYPAELTLATLICFLGSVLTGGVALVAERHDMSAWVIGFDTRLFTAVYSGIVCSGVAFYVQGVVTQARGPVFVTAFQPLCMNITTVLGSTILKEETTLGSVIGAVIIVVGLYCLIWGKSKDHLGHRKPGAAAVAELPLTLGS

SEQ ID NO: 7642 - protein, 422 aa, Zea mays
MATVAMDISKPTPAASGDEAAAAAKGRSGGGGEGLRQYYLQHIHDLQLQIRQKTHNLNRLEAQRNDLNSRVRMLREELQLLQEPGSYVGEVVKVMGKSKVLVKVHPEGKYVVDIDKSIDITKITPSTRVALRNDSYMLHLILPSKVDPLVNLMKVEKVPDSTYDMIGGLDQQIKEIKEVIELPIKHPELFESLGIAQPKGVLLYGPPGTGKTLLARAVAHHTDCTFIRVSGSELVQKYIGEGSRMVRELFVMAREHAPSIIFMDEIDSIGSARMESGTGNGDSEVQRTMLELLNQLDGFEASNKIKVLMATNRIDILDQALLRPGRIDRKIEFPNPNEDSRFDILKIHSRKMNLMRGIDLKKIAEKMNGASGAELKAVCTEAGMFALRERRVHVTQEDFEMAVAKVMKKDTEKNMSLRKLWK

SEQ ID NO: 7643 - protein, 422 aa, Setaria italica
MATVAMDISKPTPAASGDEAAAAAKGRSGGGGEGLRQYYLQHIHDLQLQIRQKTHNLNRLEAQRNDLNSRVRMLREELQLLQEPGSYVGEVVKVMGKSKVLVKVHPEGKYVVDIDKSIDITKITPSTRVALRNDSYMLHLVLPSKVDPLVNLMKVEKVPDSTYDMIGGLDQQIKEIKEVIELPIKHPELFESLGIAQPKGVLLYGPPGTGKTLLARAVAHHTDCTFIRVSGSELVQKYIGEGSRMVRELFVMAREHAPSIIFMDEIDSIGSARMESGTGNGDSEVQRTMLELLNQLDGFEASNKIKVLMATNRIDILDQALLRPGRIDRKIEFPNPNEDSRFDILKIHSRKMNLMRGIDLKKIAEKMNGASGAELKAVCTEAGMFALRERRVHVTQEDFEMAVAKVMKKDTEKNMSLRKLWK

SEQ ID NO: 7644 - protein, 422 aa, Sorghum bicolor
MATVAMDISKPTPAASGDEAAAAAKGRSGAGGEGLRQYYLQHIHDLQLQIRQKTHNLNRLEAQRNDLNSRVRMLREELQLLQEPGSYVGEVVKVMGKSKVLVKVHPEGKYVVDLDKSIDITKITPSTRVALRNDSYMLHLILPSKVDPLVNLMKVEKVPDSTYDMIGGLDQQIKEIKEVIELPIKHPELFESLGIAQPKGVLLYGPPGTGKTLLARAVAHHTDCTFIRVSGSELVQKYIGEGSRMVRELFVMAREHAPSIIFMDEIDSIGSARMESGTGNGDSEVQRTMLELLNQLDGFEASNKIKVLMATNRIDILDQALLRPGRIDRKIEFPNPNEDSRFDILKIHSRKMNLMRGIDLKKIAEKMNGASGAELKAVCTEAGMFALRERRVHVTQEDFEMAVAKVMKKDTEKNMSLRKLWK

SEQ ID NO: 7645 - protein, 424 aa, Oryza sativa
MATVAMDISKPPPAAGGDEAAAAKGRGGAGGGGGEGLRQYYLQHIHDLQLQIRQKTHNLNRLEAQRNDLNSRVRMLREELQLLQEPGSYVGEVVKVMGKSKVLVKVHPEGKYVVDIDKSIDITKITPSTRVALRNDSYMLHLILPSKVDPLVNLMKVEKVPDSTYDMIGGLDQQIKEIKEVIELPIKHPELFESLGIAQPKGVLLYGPPGTGKTLLARAVAHHTDCTFIRVSGSELVQKYIGEGSRMVRELFVMAREHAPSIIFMDEIDSIGSARMESGTGNGDSEVQRTMLELLNQLDGFEASNKIKVLMATNRIDILDQALLRPGRIDRKIEFPNPNEDSRFDILKIHSRKMNLMRGIDLKKIAEKMNGASGAELKAVCTEAGMFALRERRVHVTQEDFEMAVAKVMKKDTEKNMSLRKLWK

SEQ ID NO: 7646 - protein, 424 aa, Panicum virgatum
MATVAMDISKPTPAASGDEAAAAAAAKGRSGGGGEGLRQYYLQHIHDLQLQIRQKTHNLNRLEAQRNDLNSRVRMLREELQLLQEPGSYVGEVVKVMGKSKVLVKVHPEGKYVVDIDKSIDITKITPSTRVALRNDSYMLHLILPSKVDPLVNLMKVEKVPDSTYDMIGGLDQQIKEIKEVIELPIKHPELFESLGIAQPKGVLLYGPPGTGKTLLARAVAHHTDCTFIRVSGSELVQKYIGEGSRMVRELFVMAREHAPSIIFMDEIDSIGSARMESGTGNGDSEVQRTMLELLNQLDGFEASNKIKVLMATNRIDILDQALLRPGRIDRKIEFPNPNEDSRFDILKIHSRKMNLMRGIDLKKIAGKMNGASGAELKAVCTEAGMFALRERRVHVTQEDFEMAVAKVMKKDTEKNMSLRKLWK

SEQ ID NO: 7647 - protein, 423 aa, Unknown
  Sequence found in Organisms: Hordeum vulgare, Triticum aestivum
MAAVAMDIAKPSALPASVDDPSAASAKGRAGGGEGLRQYYLQHIHDLQLQIRTKTHNLNRLEAQRNDLNSRVRMLREELQLLQEPGSYVGEVVKVMGKSKVLVKVHPEGKYVVDLDKSIDITKITPSTRVALRNDSYMLHLILPSKVDPLVNLMKVEKVPDSTYDMIGGLDQQIKEIKEVIELPIKHPELFESLGIAQPKGVLLYGPPGTGKTLLARAVAHHTDCTFIRVSGSELVQKYIGEGSRMVRELFVMAREHAPSIIFMDEIDSIGSARMESGSGNGDSEVQRTMLELLNQLDGFEASNKIKVLMATNRIDILDQALLRPGRIDRKIEFPNPNADSRGDILKIHSRKMNLMRGIDLKKIAEKMNGASGAELKAVCTEAGMFALRERRVHVTQEDFEMAVAKVMKKDTEKNMSLRKLWK

SEQ ID NO: 7648 - protein, 422 aa, Zea mays
MATVAMDISKPTPVASGDEAAAAAKGRSGGGGEGLRQYYLQHIHDLQLQIRQKTHNLNRLEAQRNDLNSRVRMLREELQLLQEPGSYVGEVVKVMGKSKVLVKVHPEGKYVVDIDKSIDITKITPSTRVALRNDSYMLHLILPSKVDPLVNLMKVEKVPDSTYDMIGGLDQQIKEIKEVIELPIKHPELFESLGIAQPKGVLLYGPPGTGKTLLARAVAHHTDCTFIRVSGSELVQKYIGEGSRMVRELFVMAREHAPSIIFMDEIDSIGSARMESGTGNGDSEVQRTMLELLNQLDGFEASNKIKVLMATNRIDILDQALLRPGRIDRKIEFPNPNEDSRFDILKIHSRKMNLMRGIDLKKIAEKMNGASGAELKAVCTEAGMFALRERRVHVTQEDFEMAVAKVMKKDTEKNMSLRKLWK

SEQ ID NO: 7649 - protein, 422 aa, Panicum virgatum
MATVAMDISKPTPAASGDEAAAAAKGRSSGGGEGLRQYYLQHIHDLQLQIRQKTHNLNRLEAQRNDLNSRVRMLREELQLLQEPGSYVGEVVKVMGKSKVLVKVHPEGKYVVDIDKSIDITKITPSTRVALRNDSYMLHLILPSKVDPLVNLMKVEKVPDSTYDMIGGLDQQIKEIKEVIELPIKHPELFESLGIAQPKGVLLYGPPGTGKTLLARAVAHHTDCTFIRVSGSELVQKYIGEGSRMVRELFVMAREHAPSIIFMDEIDSIGSARMESGTGNGDSEVQRTMLELLNQLDGFEASNKIKVLMATNRIDILDQALLRPGRIDRKIEFPNPNEDSRFDILKIHSRKMNLMRGIDLKKIAEKMNGASGAELKAVCTEAGMFALRERRVHVTQEDFEMAVAKVMKKDTEKNMSLRKLWK

SEQ ID NO: 7650 - protein, 418 aa, Secale cereale
MATVAMDISKPPPAASGEESTKGARGGGEGLRQYYLQHIHDLQLQIRQKTHNLNRLEAQRNDLNSRVRMLREELQLLQEPGSYVGEVVKVMGKSKVLVKVHPEGKYVVDIDKSIDITKITPSTRVALRNDSYMLHLVLPSKVDPLVNLMKVEKVPDSTYDMIGGLDQQIKEIKEVIELPIKHPELFESLGIAQPKGVLLYGPPGTGKTLLARAVAHHTDCTFIRVSGSELVQKYIGEGSRMVRELFVMAREHAPSIIFMDEIDSIGSARMESGTGNGDSEVQRTMLELLNQLDGFEASNKIKVLMATNRIDILDQALLRPGRIDRKIEFPNPNEDSRGDILKIHSRRMNLMRGIDLKKIAGKMNGASGAELKAVCTEAGMFALRERRVHVTQEDFEMAVAKVMKKDNEKNMSLRKLWK

SEQ ID NO: 7651 - protein, 418 aa, Unknown
  Sequence found in Organisms: Hordeum vulgare, Leymus cinereus x Leymus triticoides, Triticum aestivum
MATVAMDISKPPPAASGDESAKGARGGGEGLRQYYLQHIHDLQLQIRQKTHNLNRLEAQRNDLNSRVRMLREELQLLQEPGSYVGEVVKVMGKSKVLVKVHPEGKYVVDIDKSIDITKITPSTRVALRNDSYMLHLVLPSKVDPLVNLMKVEKVPDSTYDMIGGLDQQIKEIKEVIELPIKHPELFESLGIAQPKGVLLYGPPGTGKTLLARAVAHHTDCTFIRVSGSELVQKYIGEGSRMVRELFVMAREHAPSIIFMDEIDSIGSARMESGTGNGDSEVQRTMLELLNQLDGFEASNKIKVLMATNRIDILDQALLRPGRIDRKIEFPNPNEDSRGDILKIHSRRMNLMRGIDLKKIAGKMNGASGAELKAVCTEAGMFALRERRVHVTQEDFEMAVAKVMKKDNEKNMSLRKLWK

SEQ ID NO: 7652 - protein, 418 aa, Brachypodium distachyon
MATVAMDISNPLPVASGEDAAKGARGGGEGLRQYYLQHIHDLQLQIRQKTHNLNRLEAQRNDLNSRVRMLREELQLLQEPGSYVGEVVKVMGKSKVLVKVHPEGKYVVDIDKSIDITKITPSTRVALRNDSYMLHLILPSKVDPLVNLMKVEKVPDSTYDMIGGLDQQIKEIKEVIELPIKHPELFESLGIAQPKGVLLYGPPGTGKTLLARAVAHHTDCTFIRVSGSELVQKYIGEGSRMVRELFVMAREHAPSIIFMDEIDSIGSARMESGTGNGDSEVQRTMLELLNQLDGFEASNKIKVLMATNRIDILDQALLRPGRIDRKIEFPNPNEDSRGDILKIHSRRMNLMRGIDLKKIAGKMNGASGAELKAVCTEAGMFALRERRVHVTQEDFEMAVAKVMKKDNEKNMSLRKLWK

SEQ ID NO: 7653 - protein, 408 aa, Pennisetum glaucum
PPALPAADDKSAAAKGRGAGKGLGRYYNQHIHDVALEFLQKTEDLHRQEAQRNVINSRVKFCRDELRLLQEPASHVGEVVKVMSKSKVLVKVHPEGKYVVDVDKNIDIAKLTPSTRVALRDGSYTLHVILPSKVDPLVNLMKVEKVPDSTYDMIGGLDQQIKEIKEVIELPIKHPELFESLGIAQPKGVILYGPPGTGKTLLARAVAHHTDCTFIRVSGSELVQKYIGEGSRMVRELFVMAREHAPSIIFMDEIDSIGSARMGSRGGDSEVQRTMLELLNQLDGFEASNKIKVLMATNRIDILDQALLRPGRIDRKIEFPNPNETSRFDILKIHSRRMNLMRDIDLKKIAAKMNGASGAELKAICTEAGMFALRERRVHVTQEDFDMAVAKVMKKDTEKNMSLRKLWK

SEQ ID NO: 7654 - protein, 423 aa, Secale cereale
MAAVAMDIAKPSALPASVDDPSAASAKGRAGSGEGLRQYYLQHIHDLQLQIRTKTHNLNRLEAQRNDLNSRVRMLREELQLLQEPGSYVGEVVKVMGKSKVLVKVHPEGKYVVDLDKSIDITKITPSTRVALRNDSYMLHLILPSKVDPLVNLMKVEKVPDSTYDMIGGLDQQIKEIKEVIELPIKHPELFESLGIAQPKGVLLYGPPGTGKTLLARAVAHHTDCTFIRVSGSELVQKYIGEGSRMVRELFVMAREHAPSIIFMDEIDSIGSARMESGSGNGDSEVQRTMLELLNQLDGFEASNKIKVLMATNRIDILDQALLRPGRIDRKIEFPNPNADSRGDILKIHSRKMNLMRGIDLKKIAEKMNGASGAELKAVCTEAGMFALRERRVHVTQEDFEMAVAKVMKKDTEKNMSLRKLWK

SEQ ID NO: 7655 - protein, 418 aa, Pseudoroegneria spicata
MATVAMDISMPPPAASGDESAKGARGGGEGLRQYYLQHIHDLQLQIRQKTHNLNRLEAQRNDLNSRVRMLREELQLLQEPGSYVGEVVKVMGKSKVLVKVHPEGKYVVDIDKSIDITKITPSTRVALRNDSYMLHLVLPSKVDPLVNLMKVEKVPDSTYDMIGGLDQQIKEIKEVIELPIKHPELFESLGIAQPKGVLLYGPPGTGKTLLARAVAHHTDCTFIRVSGSELVQKYIGEGSRMVRELFVMAREHAPSIIFMDEIDSIGSARMESGTGNGDSEVQRTMLELLNQLDGFEASNKIKVLMATNRIDILDQALLRPGRIDRKIEFPNPNEDSRGDILKIHSRRMNLMRGIDLKKIAGKMNGASGAELKAVCTEAGMFALRERRVHVTQEDFEMAVAKVMKKDNEKNMSLRKLWK

SEQ ID NO: 7656 - protein, 422 aa, Triticum aestivum
MATVAMDISKPTPVASGDEAAAAAKGRSGGGGEGLRQYYLQHIHDLQLQIRQKTHNLNRLEAQRNDLNSRVRMLREELQLLQEPGSYVGEVVKVMGKSKVLVKVHPEGKYVVDIDKSIDITKITPSTRVALRNDSYMLHLILPSKVDPLVNLMKVEKVPDSTYDMIGGLAQQIKEIKEVIELPIKHPELFESLGIAQPKGVLLYGPPGTGKTLLARAVAHHTDCTFIRVSGSELVQKYIGEGSRMVRELFVMAREHAPSIIFMDEIDSIGSARMESGTGNGDSEVQRTMLELLNQLDGFEASNKIKVLMATNRIDILDQALLRPGRIDRKIEFPNPNEDSRFDILKIHSRKMNLMRGIDLKKIAEKMNGASGAELKAVCTEAGMFALRERRVHVTQEDFEMAVAKVMKKDTEKNMSLRKLWK

SEQ ID NO: 7657 - protein, 422 aa, Brachypodium distachyon
MAAVEMAISKPSTLPGVDDPASSAAKGRAGGGEGLRQYYQQHIHDLQLQIRQKTHNLNRLEAQRNDLNSRVRMLREELQLLQEPGSYVGEVVKVMGKSKVLVKVHPEGKYVVDLDKSIDITKITPSTRVALRNDSYMLHLILPSKVDPLVNLMKVEKVPDSTYDMIGGLDQQIKEIKEVIELPIKHPELFESLGIAQPKGVLLYGPPGTGKTLLARAVAHHTDCTFIRVSGSELVQKYIGEGSRMVRELFVMAREHAPSIIFMDEIDSIGSARMESGTGNGDSEVQRTMLELLNQLDGFEASNKIKVLMATNRIDILDQALLRPGRIDRKIEFPNPNADSRGDILKIHSRKMNLMRGIDLKKIAEKMNGASGAELKAVCTEAGMFALRERRVHVTQEDFEMAVAKVMKKDTEKNMSLRKLWK

SEQ ID NO: 7658 - protein, 416 aa, Avena sativa
MATVAMDVSKPTPGDESAAKGARGGGEGLRQYYLQHIHDLQLQIRTSTHNLNRLEAQRNDLNSKVRALREELQLLQEPGSYVGEVVKVMGKSKVLVKVHPEGKYVVDIDKSIDITKITPSTRVALRNDSYMLHLILPSKVDPLVNLMKVEKVPDSTYDMIGGLDQQIKEIKEVIELPIKHPELFESLGIAQPKGVLLYGPPGTGKTLLARAVAHHTDCTFIRVSGSELVQKYIGEGSRMVRELFVMAREHAPSIIFMDEIDSIGSARMESGTGNGDSEVQRTMLELLNQLDGFEASNKIKVLMATNRIDILDQALLRPGRIDRKIEFPNPNEDSRGDILKIHSRRMNLMRGIDLKKIAGKMNGASGAELKAVCTEAGMFALRERRVHVTQEDFEMAVAKVMKKDNEKNMSLRKLWK

SEQ ID NO: 7659 - protein, 420 aa, Avena sativa
MAAVAMDIAKPSAVPENVEDPAKGRAGGGGEGLRQYYLQHIHDLQLQIRQKTHNLNRLEAQRNDLNSRVRMLREELQLLQEPGSYVGEVVKVMGKSKVLVKVHPEGKYVVDLDKSIDINKITPSTRVALRNDSYMLHLILPSKVDPLVNLMKVEKVPDSTYDMIGGLDQQIKEIKEVIELPIKHPELFESLGIAQPKGVLLYGPPGTGKTLLARAVAHHTDCTFIRVSGSELVQKYIGEGSRMVRELFVMAREHAPSIIFMDEIDSIGSARMESGTGNGDSEVQRTMLELLNQLDGFEASNKIKVLMATNRIDILDQALLRPGRIDRKIEFPNPNADSRGDILKIHSRKMNLMRGIDLKKIAEKMNGASGAELKAVCTEAGMFALRERRVHVTQEDFEMAVAKVMKKDTEKNMSLRKLWK

SEQ ID NO: 7660 - protein, 417 aa, Phalaenopsis aphrodite
MATQVLPQPEADGEIRSPSTKTRGGGGEGLRQYYLQHIHDLQLQVRQKSHNLNRLEAQRNDLNAKVRALREELQLLQEPGSYVGEVVKVMGKSKVLVKVHPEGKYVVDVDKNIDITKITPSTRVALRNDSYVLHLILPSKVDPLVNLMKVEKVPDSTYDMIGGLDQQIKEIKEVIELPIKHPELFESLGIAQPKGVLLYGPPGTGKTLLARAVAHHTDCTFIRVSGSELVQKYIGEGSRMVRELFVMAREHAPSIIFMDEIDSIGSARMESGSGNGDSEVQRTMLELLNQLDGFEASNKIKVLMATNRIDILDQALLRPGRIDRKIEFPNPNEESRWDILKIHSRKMNLMRGIDLKKIAEKMNGASGAELKAVCTEAGMFALRERRVHVTQEDFEMAVAKVMKKETEKNMSLRKLWK

SEQ ID NO: 7661 - protein, 419 aa, Phalaenopsis aphrodite
MASVKIQVLPQPEAEEEFRSPPTKTRGGGEGLRQYYLQHIHDLQLQVRQKSHNLNRLEAQRNDLNAKVRALREELQLLQEPGSYVGEVVKVMGKSKVLVKVHPEGKYVVDVDKTIDITKITPSTRVALRNDSYVLHLILPSKVDPLVNLMKVEKVPDSTYDMIGGLDQQIKEIKEVIELPIKHPELFESLGIAQPKGVLLYGPPGTGKTLLARAVAHHTDCTFIRVSGSELVQKYIGEGSRMVRELFVMAREHAPSIIFMDEIDSIGSARMESGSGNGDSEVQRTMLELLNQLDGFEASNKIKVLMATNRIDILDQALLRPGRIDRKIEFPNPNEESRWDILKIHSRKMNLMRGIDLKKIAEKMNGASGAELKAVCTEAGMFALRERRVHVTQEDFEMAVAKVMKKETEKNMSLRKLWK

SEQ ID NO: 7662 - protein, 416 aa, Aristolochia fimbriata
MATAIETKQAEVAAEEMCSAKAGKQGEGLRQYYLQHIHDLQLQVRQKTHNLNRLEAQRNDLNSRVRMLREELQLLQEPGSYVGEVVKVMGKSKVLVKVHPEGKYVVDIDKNIDITKITPSTRVALRNDSYVLHLILPSKVDPLVNLMKVEKVPDSTYDMIGGLDQQIKEIKEVIELPIKHPELFESLGIAQPKGVLLYGPPGTGKTLLARAVAHHTDCTFIRVSGSELVQKYIGEGSRMVRELFVMAREHAPSIIFMDEIDSIGSARMESGTGNGDSEVQRTMLELLNQLDGFEASNKIKVLMATNRIDILDQALLRPGRIDRKIEFPNPNEESRLDILKIHSRKMNLMRGIDLKKIAEKMNGASGAELKAVCTEAGMFALRERRVHVTQEDFEMAVAKVMKKETEKNMSLRKLWK

SEQ ID NO: 7663 - protein, 417 aa, Vitis vinifera
MATASTERSLAEPMAEERCTAKTKQQGEGLKQYYLQHIHDLQLQVRQKAHNLNRLEAQRNDLNSRVRMLREELQLLQEPGSYVGEVVKVMGKSKVLVKVHPEGKYVVDIDKNIDITKITPSTRVALRNDSYVLHLILPSKVDPLVNLMKVEKVPDSTYDMIGGLDQQIKEIKEVIELPIKHPELFESLGIAQPKGVLLYGPPGTGKTLLARAVAHHTDCTFIRVSGSELVQKYIGEGSRMVRELFVMAREHAPSIIFMDEIDSIGSARMESGSGNGDSEVQRTMLELLNQLDGFEASNKIKVLMATNRIDILDQALLRPGRIDRKIEFPNPNEESRWDILKIHSRKMNLMRGIDLKKIAEKMNGASGAELKAVCTEAGMFALRERRVHVTQEDFEMAVAKVMKKETEKNMSLRKLWK

SEQ ID NO: 7664 - protein, 418 aa, Ambrosia trifida
MASVDVAMKPSDPTDRTENCSSKSAKSGEGLRQYYLQHIHDAQLQVRQKTHNLNRLEAQRNELNSRVRMLKEELQLLQEPGSYVGEVVKVMGKSKVLVKVHPEGKYVVDIDKSIDITKITPSTRVALRNDSYVLHLVLPSKVDPLVNLMKVEKVPDSTYDMIGGLDQQIKEIKEVIELPIKHPELFESLGIAQPKGVLLYGPPGTGKTLLARAVAHHTDCTFIRVSGSELVQKYIGEGSRMVRELFVMAREHAPSIIFMDEIDSIGSARMESGSGNGDSEVQRTMLELLNQLDGFEASNKIKVLMATNRIDILDQALLRPGRIDRKIEFPNPNEDSRFDILKIHSRKMNLMRGIDLKKIAEKMNGASGAELKAVCTEAGMFALRERRVHVTQEDFEMAVAKVMKKDTEKNMSLRKLWK

SEQ ID NO: 7665 - protein, 417 aa, Gossypium hirsutum
MATVSVERKQPATAEEMCTAKSGAKQGEGLRQYYLQHIHELQLNLRQKTHNLNRLEAQRNELNSRVRMLREELQLLQEPGSYVGEVVKVMGKNKVLVKVHPEGKYVVDIDKSIDITKITPSTRVALRNDSYVLHLILPSKVDPLVNLMKVEKVPDSTYDMIGGLDQQIKEIKEVIELPIKHPELFESLGIAQPKGVLLYGPPGTGKTLLARAVAHHTDCTFIRVSGSELVQKYIGEGSRMVRELFVMAREHAPSIIFMDEIDSIGSARMESGSGNGDSEVQRTMLELLNQLDGFEASNKIKVLMATNRIDILDQALLRPGRIDRKIEFPNPNEESRQDILKIHSRRMNLMRGIDLKKIAEKMNGASGAELKAVCTEAGMFALRERRVHVTQEDFEMAVAKVMKKETEKNMSLRKLWK

SEQ ID NO: 7666 - protein, 417 aa, Unknown
  Sequence found in Organisms: Gossypium hirsutum, Gossypium raimondii
MATVDIERKQAASAEEICTAKSGAKQGEGLRQYYIQHIHELQLNLRQKTHNLNRLEAQRNELNSQVRMLREELQLLQEPGSYVGEVVKVMGKNKVLVKVHPEGKYVVDIDKNIDITKITPSTRVALRNDSYVLHLILPSKVDPLVNLMKVEKVPDSTYDMIGGLDQQIKEIKEVIELPIKHPELFESLGIAQPKGVLLYGPPGTGKTLLARAVAHHTDCTFIRVSGSELVQKYIGEGSRMVRELFVMAREHAPSIIFMDEIDSIGSARMESGSGNGDSEVQRTMLELLNQLDGFEASNKIKVLMATNRIDILDQALLRPGRIDRKIEFPNPNEESRFDILKIHSRRMNLMRGIDLKKIAEKMNGASGAELKAVCTESGMFALRERRVHVTQEDFEMAVAKVMKKESEKNMSLRKLWK

SEQ ID NO: 7667 - protein, 416 aa, Olea europaea
MATVAIETRQADEAKNHHHQSASGGGEGLRQYYQQRIQDLQLLVRQRDHDLQRLEAQRNDLNARVRSLKEELQLLQEPGSYVGEVVKVMGKSKVLVKVHPEGKYVVDIDKNIDITKITPSMRVALRNDSYVLHLILPSKVDPLVNLMKVEKVPDSTYDMIGGLDQQIKEIKEVIELPIKHPELFESLGIAQPKGVLLYGPPGTGKTLLARAVAHHTDCTFIRVSGSELVQKYIGEGSRMVRELFVMAREHAPSIIFMDEIDSIGSARMESGSGNGDSEVQRTMLELLNQLDGFEASNKIKVLMATNRIDILDQALLRPGRIDRKIEFPNPNEESRFDILKIHSRKMNLMRGIDLKKIAEKMNGASGAELKAVCTEAGMFALRERRVHVTQEDFEMAVAKVMKKETDKNMSLRKLWK

SEQ ID NO: 7668 - protein, 418 aa, Platanus occidentalis
MATAAIETKQAEAVAAEEMCSAKAMKQGEGLRQYYLQHIHDLQLQVRQKTHNLNRLEAQRNDLNSRVRMLREELQLLQEPGSYVGEVVKVMGKSKVLVKVHPEGKYVVDIDKNIDITKITPSTRVALRNDSYVLHLILPSKVDPLVNLMKVEKVPDSTYDMIGGLDQQIKEIKEVIELPIKHPELFESLGIAQPKGVLLYGPPGTGKTLLARAVAHHTDCTFIRVSGSELVQKYIGEGSRMVRELFVMAREHAPSIIFMDEIDSIGSARMESGTGNGDSEVQRTMLELLNQLDGFEASNKIKVLMATNRIDILDQALLRPGRIDRKIEFPNPNEESRFDILKIHSRKMNLMRGIDLKKIAEKMNGASGAELKAVCTEAGMFALRERRVHVTQEDFEMAVAKVMKKETEKNMSLRKLWK

SEQ ID NO: 7669 - protein, 415 aa, Quercus alba
MATVGIEAVAAPAEETCSAKASKQGEGLRQYYLQHIHELQLQVRQKTHNLNRLEAQRNELNSRVRMLREELQLLQEPGSYVGEVVKVMGKNKVLVKVHPEGKYVVDIDKNIDITKITPSTRVALRNDSYVLHLILPSKVDPLVNLMKVEKVPDSTYDMIGGLDQQIKEIKEVIELPIKHPELFESLGIAQPKGVLLYGPPGTGKTLLARAVAHHTDCTFIRVSGSELVQKYIGEGSRMVRELFVMAREHAPSIIFMDEIDSIGSARMESGSGNGDSEVQRTMLELLNQLDGFEASNKIKVLMATNRIDILDQALLRPGRIDRKIEFPNPNEESRFDILKIHSRRMNLMRGIDLKKIAEKMNGASGAELKAVCTEAGMFALRERRVHVTQEDFEMAVAKVMKKETEKNMSLRKLWK

SEQ ID NO: 7670 - protein, 423 aa, Amorphophallus konjac
MAAMEVDTKQAASASSAENEMCSPAVKVRGGGGEGLRQYYLQHIHDLQLQVRQKTHNLNRLEAQRNDLNSRVRMLREELQLLQEPGSYVGEVVKVMGKSKVLVKVHPEGKYVVDIDKSIDITKITPSTRVALRNDSYVLHLVLPSKVDPLVNLMKVEKVPDSTYDMIGGLDQQIKEIKEVIELPIKHPELFESLGIAQPKGVLLYGPPGTGKTLLARAVAHHTDCTFIRVSGSELVQKYIGEGSRMVRELFVMAREHAPSIIFMDEIDSIGSARMESGTGNGDSEVQRTMLELLNQLDGFEASNKIKVLMATNRIDILDQALLRPGRIDRKIEFPNPNEESRFDILKIHSRKMNLMRGIDLKKIAEKMNGASGAELKAVCTEAGMFALRERRVHVTQEDFEMAVAKVMKKDTEKNMSLRKLWK

SEQ ID NO: 7671 - protein, 419 aa, Euonymus alatus
MATVGVEMKQPELTVTEEMCSAKGAAKQGEGLRQYYYQHNHKLQLLLRQKTHNLNRLEAQRNDLNSKVRMLREELQLLQEPGSYVGEVVKVMGKNKVLVKVHPEGKYVVDIDKNIDITKITPSTRVALRNDSYVLHLILPSKVDPLVNLMKVEKVPDSTYDMIGGLDQQIKEIKEVIELPIKHPELFESLGIAQPKGVLLYGPPGTGKTLLARAVAHHTDCTFIRVSGSELVQKYIGEGSRMVRELFVMAREHAPSIIFMDEIDSIGSARMESGSGNGDSEVQRTMLELLNQLDGFEASNKIKVLMATNRIDILDQALLRPGRIDRKIEFPNPNEESRFDILKIHSRRMNLMRGIDLKKIAEKMNGASGAELKAVCTEAGMFALRERRVHVTQEDFEMAVAKVMKKETEKNMSLRKLWK

SEQ ID NO: 7672 - protein, 417 aa, Unknown
  Sequence found in Organisms: Gossypium hirsutum, Gossypium raimondii
MATVGVERKQPATAEEMCTAKSGAKQGEGLRQYYLQHIHELQLNLRQKTHNLNRLEAQRNELNSRVRMLREELQLLQEPGSYVGEVVKVMGKNKVLVKVHPEGKYVVDIDKSIDITKITPSTRVALRNDSYVLHLILPSKVDPLVNLMKVEKVPDSTYDMIGGLDQQIKEIKEVIELPIKHPELFESLGIAQPKGVLLYGPPGTGKTLLARAVAHHTDCTFIRVSGSELVQKYIGEGSRMVRELFVMAREHAPSIIFMDEIDSIGSARMESGSGNGDSEVQRTMLELLNQLDGFEASNKIKVLMATNRIDILDQALLRPGRIDRKIEFPNPNEESRQDILKIHSRRMNLMRGIDLKKIAEKMNGASGAELKAVCTEAGMFALRERRVHVTQEDFEMAVAKVMKKETEKNMSLRKLWK

SEQ ID NO: 7673 - protein, 417 aa, Vitis vinifera
MATASTERSLAEPMAEERCTAKTKQQGEGLKQYYLQHNHDLQLQVRQKAHNLNRLEAQRNDLNSRVRMLREELQLLQEPGSYVGEVVKVMGKSKVLVKVHPEGKYVVDIDKNIDITKITPSTRVALRNDSYVLHLILPSKVDPLVNLMKVEKVPDSTYDMIGGLDQQIKEIKEVIELPIKHPELFESLGIAQPKGVLLYGPPGTGKTLLARAVAHHTDCTFIRVSGSELVQKYIGEGSRMVRELFVMAREHAPSIIFMDEIDSIGSARMESGSGNGDSEVQRTMLELLNQLDGFEASNKIKVLMATNRIDILDQALLRPGRIDRKIEFPNPNGESRWDILKIHSRKMNLMRGIDLKKIAEKMNGASGAELKAVCTEAGMFALRERRVHVTQEDFEMAVAKVMKKETEKNMSLRKLWK

SEQ ID NO: 7674 - protein, 420 aa, Artemisia annua
MASVDVAMKSSSESAGGIESCSSKGGGKTGEGLRQYYLQHIHDAQLQVRQKTHNLNRLEAQRNELNSRVRMLKEELQLLQEPGSYVGEVVKVMGKSKVLVKVHPEGKYVVDIDKSIDITKITPSTRVALRNDSYVLHLVLPSKVDPLVNLMKVEKVPDSTYDMIGGLDQQIKEIKEVIELPIKHPELFESLGIAQPKGVLLYGPPGTGKTLLARAVAHHTDCTFIRVSGSELVQKYIGEGSRMVRELFVMAREHAPSIIFMDEIDSIGSARMESGSGNGDSEVQRTMLELLNQLDGFEASNKIKVLMATNRIDILDQALLRPGRIDRKIEFPNPNEDSRFDILKIHSRKMNLMRGIDLKKIAEKMNGASGAELKAVCTEAGMFALRERRVHVTQEDFEMAVAKVMKKETEKNMSLRKLWK

SEQ ID NO: 7675 - protein, 420 aa, Vitis vinifera
MATAVTELSQSGPAMVGEVCTAKTTSSKQGDGLRQYYLQHIHDLQLQVRQKSHNLNRLEAQRNDLNSRVRMLREELQLLQEPGSYVGEVVKVMGKSKVLVKVHPEGKYVVDIDKNIDITKITPSTRVALRNDSYVLHLILPSKVDPLVNLMKVEKVPDSTYDMIGGLDQQIKEIKEVIELPIKHPELFESLGIAQPKGVLLYGPPGTGKTLLARAVAHHTDCTFIRVSGSELVQKYIGEGSRMVRELFVMAREHAPSIIFMDEIDSIGSARMESGTGNGDSEVQRTMLELLNQLDGFEASNKIKVLMATNRIDILDQALLRPGRIDRKIEFPNPNEESRFDILKIHSRKMNLMRGIDLKKIAEKMNGASGAELKAVCTEAGMFALRERRVHVTQEDFEMAVAKVMKKETEKNMSLRKLWK

SEQ ID NO: 7676 - protein, 417 aa, Mimulus guttatus
MATAAIETRRADELKQQHQQGAGTGGGEGLRQYYQQRIQDMQLLVRQKDHDLQRLEAQRNDLNSRVRSLKEELQLLQEPGSYVGEVVKVMGKSKVLVKVHPEGKYVVDIDKSIDITKITPSTRVALRNDSYVLHLVLPSKVDPLVNLMKVEKVPDSTYDMIGGLDQQIKEIKEVIELPIKHPELFESLGIAQPKGVLLYGPPGTGKTLLARAVAHHTDCTFIRVSGSELVQKYIGEGSRMVRELFVMAREHAPSIIFMDEIDSIGSARMESGSGNGDSEVQRTMLELLNQLDGFEASNKIKVLMATNRIDILDQALLRPGRIDRKIEFPNPNEDSRADILKIHSRKMNLMRGIDLKKIAEKMNGASGAELKAVCTEAGMFALRERRVHVTQEDFEMAVAKVMKKETEKNMSLRKLWK

SEQ ID NO: 7677 - protein, 417 aa, Prunus persica
MAAVGVEIKHPEAVPEEACSAKATKQGEGLRQYYLQHIHELQLQVRQKTHNLNRLEAQRNELNSRVRMLREELQLLQEPGSYVGEVVKVMGKNKVLVKVHPEGKYVVDIDKNIDVTKITPSTRVALRNDSYVLHLILPSKVDPLVNLMKVEKVPDSTYDMIGGLDQQIKEIKEVIELPIKHPELFESLGIAQPKGVLLYGPPGTGKTLLARAVAHHTDCTFIRVSGSELVQKYIGEGSRMVRELFVMAREHAPSIIFMDEIDSIGSARMESGSGNGDSEVQRTMLELLNQLDGFEASNKIKVLMATNRIDILDQALLRPGRIDRKIEFPNPNEESRWDILKIHSRRMNLMRGIDLKKIAEKMNGASGAELKAVCTEAGMFALRERRVHVTQEDFEMAVAKVMKKETEKNMSLRKLWK

SEQ ID NO: 7678 - protein, 623 aa, Setaria italica
MATVAMDVSQPSALPADGDKAAAAKGSGVGKGLERYYKQQIHDVDLGLLQKIKDLRRQEAQRNVINSRVKFCRDELRLLQEPASHVGEVVKVMSKSKVLVKVHPEGKYIVDVDKSIDIAKLMPSTRVALRSGSYMLHVILPSKVDPLVNLMKVEKVPDSTYDMIGGLDQQIKEIKEVIELPIKHPELFESLGIAQPTGVILYGPPGTGKTLLARAVAHHTDCTFIRVSGSELVQKYIGEGSRMVRELFVMAREHAPSIIFMDEIDSIGSARMGSGGGRGDSEVQRTMLELLNQLDGFEATHKIKVLMATNRIDILDQALLRPGRIDRKIEFPNPNETSRFDILKIHSRRMNLMRDIDLKKIAAKMNGASGAELKAICTEAGMFALRERRVHVTQEDFDMAVAKALPNTQPVDYPSFKLVLVGDGGTGKTTFVKRHISGEFEKRYEPTIGVEVRPLDFTTSHGKLRFYCWDTAGQEKFGGLRDGYYINGQCAIIMFDVTSRLTYKNVPTWHRDISRVCENIPVVLCGNKVDVKNRQVKAKMVTYHRKKNLQYYEISAKSNYNFEKPFLYLARKLAGNMDLRFEAEIALVPADVTIDLAAQKKIEEEITAAASMPLPDEDEDIMD

SEQ ID NO: 7679 - protein, 420 aa, Ambrosia trifida
MASVDVAMKPSDPTDRNENCSSKSTSAKSGEGLRQYYLQHIHDAQLQVRQKTHNLNRLEAQRNELNSRVRMLKEELQLLQEPGSYVGEVVKVMGKSKVLVKVHPEGKYVVDIDKSIDITKITPSTRVALRNDSYVLHLVLPSKVDPLVNLMKVEKVPDSTYDMIGGLDQQIKEIKEVIELPIKHPELFESLGIAQPKGVLLYGPPGTGKTLLARAVAHHTDCTFIRVSGSELVQKYIGEGSRMVRELFVMAREHAPSIIFMDEIDSIGSARMESGSGNGDSEVQRTMLELLNQLDGFEASNKIKVLMATNRIDILDQALLRPGRIDRKIEFPNPNEDSRFDILKIHSRKMNLMRGIDLKKIAEKMNGASGAELKAVCTEAGMFALRERRVHVTQEDFEMAVAKVMKKDTEKNMSLRKLWK

SEQ ID NO: 7680 - protein, 419 aa, Chelidonium majus
MATAAVEIKQAETGGVEICSGSKTMAKQGEGLRQYYLQHIHDLQLQVRQKTHNLNRLEAQRNDLNSRVRMLREELQLLQEPGSYVGEVVKVMGKSKVLVKVHPEGKYVVDIDKSIDITKITPSTRVALRNDSYVLHLILPSKVDPLVNLMKVEKVPDSTYDMIGGLDQQIKEIKEVIELPIKHPELFESLGIAQPKGVLLYGPPGTGKTLLARAVAHHTDCTFIRVSGSELVQKYIGEGSRMVRELFVMAREHAPSIIFMDEIDSIGSARMESGTGNGDSEVQRTMLELLNQLDGFEASNKIKVLMATNRIDILDQALLRPGRIDRKIEFPNPNEESRWDILKIHSRKMNLMRGIDLKKIAEKMHGASGAELKAVCTEAGMFALRERRVHVTQEDFEMAVAKVMKKETEKNMSLRKLWK

SEQ ID NO: 7681 - protein, 419 aa, Tabernaemontana elegans
MATAEIETNRSEAERGETCSAKGSMVKQGEGLRQYYLQHIHDLQLQVRQKTHNLNRLEAQRNELNSKVRMLKEELQLLQEPGSYVGEVVKVMGKSKVLVKVHPEGKYVVDIDKSIDITKITPSTRVALRNDSYVLHLILPSKVDPLVNLMKVEKVPDSTYDMIGGLDQQIKEIKEVIELPIKHPELFESLGIAQPKGVLLYGPPGTGKTLLARAVAHHTDCTFIRVSGSELVQKYIGEGSRMVRELFVMAREHAPSIIFMDEIDSIGSARMESGSGNGDSEVQRTMLELLNQLDGFEASNKIKVLMATNRIDILDQALLRPGRIDRKIEFPNPNEDSRFDILKIHSRKMNLMRGIDLKKIAEKMNGASGAELKAVCTEAGMFALRERRVHVTQEDFEMAVAKVMKKETEKNMSLRKLWK

SEQ ID NO: 7682 - protein, 416 aa, Utricularia gibba
SAATVDDRPMEEPKQQSQQGGSARGGEGLRQYYNQRIQDMHLLVRQKVYDLQRLEAQRNDLNARVRSLKEELQLLQEPGSYVGEVVKVMGKSKVLVKVHPEGKYVVDVDKSIDITKITPSTRVALRNDSYVLHLILPSKVDPLVNLMKVEKVPDSTYDMIGGLDQQIKEIKEVIELPIKHPELFESLGIAQPKGVLLYGPPGTGKTLLARAVAHHTDCTFIRVSGSELVQKYIGEGSRMVRELFVMAREHAPSIIFMDEIDSIGSSRMESGSGNGDSEVQRTMLELLNQLDGFEASNKIKVLMATNRIDILDQALLRPGRIDRKIEFPNPNEDSRFDILKIHSRKMNLMRGIDLKKVAEKMNGASGAELKAVCTEAGMFALRERRVHVTQEDFEMAVAKVMKKDTDKNMSLRKLWK

SEQ ID NO: 7683 - protein, 419 aa, Manihot esculenta
MATVGVEMKQPESIMVDETCSAKAAGKQGEGLRQYYLQHIHELQLQVRQKTHNLNRLEAQRNELNSRVRMLREELQLLQEPGSYVGEVVKVMGKNKVLVKVHPEGKYVVDIDKNIDITKITPSTRVALRNDSYVLHLILPSKVDPLVNLMKVEKVPDSTYDMIGGLDQQIKEIKEVIELPIKHPELFESLGIAQPKGVLLYGPPGTGKTLLARAVAHHTDCTFIRVSGSELVQKYIGEGSRMVRELFVMAREHAPSIIFMDEIDSIGSARMESGSGNGDSEVQRTMLELLNQLDGFEASNKIKVLMATNRIDILDQALLRPGRIDRKIEFPNPNEDSRLDILKIHSRRMNLMRGIDLKKIAEKMNGASGAELKAVCTEAGMFALRERRVHVTQEDFEMAVAKVMKKETEKNMSLRKLWK

SEQ ID NO: 7684 - protein, 419 aa, Manihot esculenta
MATVGLETKQAESIMAEETCSAKAAGKQGEGLRQYYLQHIHELQLQVRQKTHNLNRLEAQRNELNSRVRMLREELQLLQEPGSYVGEVVKVMGKNKVLVKVHPEGKYVVDIDKNIDITKITPSTRVALRNDSYVLHLILPSKVDPLVNLMKVEKVPDSTYDMIGGLDQQIKEIKEVIELPIKHPELFESLGIAQPKGVLLYGPPGTGKTLLARAVAHHTDCTFIRVSGSELVQKYIGEGSRMVRELFVMAREHAPSIIFMDEIDSIGSARMESGSGNGDSEVQRTMLELLNQLDGFEASNKIKVLMATNRIDILDQALLRPGRIDRKIEFPNPNEESRLDILKIHSRRMNLMRGIDLKKIAEKMNGASGAELKAVCTEAGMFALRERRVHVTQEDFEMAVAKVMKKETEKNMSLRKLWK

SEQ ID NO: 7685 - protein, 140 aa, Gossypium hirsutum
MGKKQGLSQGSSRRKNMLSILIRILISQKITPSTRVALRNDSYVLHLILPSKVDPLVNLMKVEKVPDSTYDMIGGLDQQIKEIKEVIELPIKHPELFESLGIAQPKVFCCMDHRVQEKLYWLELWPIILIALLSGFPVLN

SEQ ID NO: 7686 - protein, 228 aa, Ipomoea nil
MATVEVRKSTTESGREDSCSAKPMKQGEGLKQYYMQHIHDLQLQVRQKGHNLNRLEAQRNELNSKVRMLKEELQLLQEPGSYVGEVVKVMGKSKVLVKVHPEGKYVVDIDKSIDITKITPSTRVALRNDSYVLHLILPSKVDPLVNLMKVEKVPDSTYDMIGGLDQQIKEIKEVIELPIKHPELFESLGIAQPKGVLLYGPPGTGKHCWQELLHIILIVPSLGFLALN

SEQ ID NO: 7687 - protein, 417 aa, Malus domestica
MAAAGVEIKHPDAAPEETCSAKASKQGEGLRQYYLQHIHELQLQVRQKTHNLNRLEAQRNELNSRVRMLREELQLLQEPGSYVGEVVKVMGKNKVLVKVHPEGKYVVDIDKNIDITKITPSTRVALRNDSYVLHLVLPSKVDPLVNLMKVEKVPDSTYDMIGGLDQQIKEIKEVIELPIKHPELFESLGIAQPKGVLLYGPPGTGKTLLARAVAHHTDCTFIRVSGSELVQKYIGEGSRMVRELFVMAREHAPSIIFMDEIDSIGSARMESGSGNGDSEVQRTMLELLNQLDGFEASNKIKVLMATNRIDILDQALLRPGRIDRKIEFPNPSEESRWDILKIHSRRMNLMRGIDLKKIAEKMNGASGAELKAVCTEAGMFALRERRVHVTQEDFEMAVAKVMKKENEKNMSLRKLWK

SEQ ID NO: 7688 - protein, 418 aa, Orobanche aegyptiaca
MATAAIETRQVDESKQTHQQGAGAGGGGEGLRQYYQQRIQDMQLSVRQKVHDLQRLEAQRNDLNARVRSLKEELQLLQEPGSYVGEVVKVMGKSKVLVKVHPEGKYVVDIDKSIDITKITPSTRVALRNDSYVLHLVLPSKVDPLVNLMKVEKVPNSTYDMIGGLDQQIKEIKEVIELPIKHPELFESLGIAQPKGVLLYGPPGTGKTLLARAVAHHTDCTFIRVSGSELVQKYIGEGSRMVRELFVMAREHAPSIIFMDEIDSIGSARMESGSGNGDSEVQRTMLELLNQLDGFEASNKIKVLMATNRIDILDQALLRPGRIDRKIEFPNPNEESRFDILKIHSRRMNLMRGIDLKKIAEKMNGASGAELKAVCTEAGMFALRERRVHVTQEDFEMAVAKVMKKENEKNMSLRKLWK

SEQ ID NO: 7689 - protein, 419 aa, Catharanthus roseus
MATAEIETNRSEAEREESCSAKGSMVKQGEGLRQYYMQHIHDLQLQVRQKTHNLNRLEAQRNELNSKVRMLKEELQLLQEPGSYVGEVVKVMGKSKVLVKVHPEGKYVVDIDKSIDITKITPSTRVALRNDSYVLHLILPSKVDPLVNLMKVEKVPDSTYDMIGGLDQQIKEIKEVIELPIKHPELFESLGIAQPKGVLLYGPPGTGKTLLARAVAHHTDCTFIRVSGSELVQKYIGEGSRMVRELFVMAREHAPSIIFMDEIDSIGSARMESGSGNGDSEVQRTMLELLNQLDGFEASNKIKVLMATNRIDILDQALLRPGRIDRKIEFPNPNEESRFDILKIHSRKMNLMRGIDLKKIAEKMNGASGAELKAVCTEAGMFALRERRVHVTQEDFEMAVAKVMKKETEKNMSLRKLWK

SEQ ID NO: 7690 - protein, 396 aa, Citrus sinensis
MAAVGIETKQPESAAPEEVCAAKGASKQGEGLRQYYLQHIHELQLQVRQKTHNLNRLEAQRNELNSRVRMLKEELQLLQEPGSYVGEVVKVMGKNKVLVKVHPEGKYVVDIDKSIDITKITPSTRVALRNDSYVLHLILPSKVDPLVNLMKVEKVPDSTYDMIGGLDQQIKEIKEVIELPIKHPELFESLGIAQPKGVLLYGPPGTGKTLLARAVAHHTDCTFIRVSGSELVQKYIGEGSRMVRELFVMAREHAPSIIFMDEIDSIGSARMESGSGNGDSEVQRTMLELLNQLDGFEASNKIKVLMATNRIDILDQALLRPGRIDRKIEFPNPNEESRLDILKIHSRRMNLMRGIDLKKIAEKMNGASGAELKAVCTEAGMFALKREKDPCNTGRF

SEQ ID NO: 7691 - protein, 417 aa, Malus domestica
MAAAGVEIKHPDAAPEETCSAKASKQGEGLRQYYLQHIHEHQLQVRQKTHNLNRLEAQRNELNSRVRMLREELQLLQEPGSYVGEVVKVMGKNKVLVKVHPEGKYVVDIDKNIDITKITPSTRVALRNDSYVLHLVLPSKVDPLVNLMKVEKVPDSTYDMIGGLDQQIKEIKEVIELPIKHPELFESLGIAQPKGVLLYGPPGTGKTLLARAVAHHTDCTFIRVSGSELVQKYIGEGSRMVRELFVMAREHAPSIIFMDEIDSIGSARMESGSGNGDSEVQRTMLELLNQLDGFEASNKIKVLMATNRIDILDQALLRPGRIDRKIEFPNPSEESRWDILKIHSRRMNLMRGIDLKKIAEKMNGASGAELKAVCTEAGMFALRERRVHVTQEDFEMAVAKVMKKENEKNMSLRKLWK

SEQ ID NO: 7692 - protein, 418 aa, Cannabis sativa
MATVFVESKQPEAMMPEETCSSIAAKQGEGLKQYYLQHIHDLQLQVRLKTHNLNRLEAQRNELNSRVRMLREELQLLQEPGSYVGEVVKVMGKNKVLVKVHPEGKYVVDIDKSIDITKITPSTRVALRNDSYVLHLVLPSKVDPLVNLMKVEKVPDSTYDMIGGLDQQIKEIKEVIELPIKHPELFESLGIAQPKGVLLYGPPGTGKTLLARAVAHHTDCTFIRVSGSELVQKYIGEGSRMVRELFVMAREHAPSIIFMDEIDSIGSARMESGSGNGDSEVQRTMLELLNQLDGFEASNKIKVLMATNRIDILDQALLRPGRIDRKIEFPNPNGESRFDILKIHSRRMNLMRGIDLKKIAEKMNGASGAELKAVCTEAGMFALRERRVHVTQEDFEMAVAKVMKKDTDKNMSLRKLWK

SEQ ID NO: 7693 - protein, 420 aa, Flaveria ramosissima
MATVDVAMKPSDSVDRDDNCSSRPTTAKSGEGLRQYYLQHIHDAQLQVRQKTHNLNRLEAQRNELNSRVRMLKEELQLLQEPGSYVGEVVKVMGKSKVLVKVHPEGKYVVDIDKSIDITKITPSTRVALRNDSYVLHLVLPSKVDPLVNLMKVEKVPDSTYDMIGGLDQQIKEIKEVIELPIKHPELFESLGIAQPKGVLLYGPPGTGKTLLARAVAHHTDCTFIRVSGSELVQKYIGEGSRMVRELFVMAREHAPSIIFMDEIDSIGSARMESGSGNGDSEVQRTMLELLNQLDGFEASNKIKVLMATNRIDILDQALLRPGRIDRKIEFPNPNEDSRFDILKIHSRKMNLMRGIDLKKIAEKMNGASGAELKAVCTEAGMFALRERRVHVTQEDFEMAVAKVMKKETEKNMSLRKLWK

SEQ ID NO: 7694 - protein, 417 aa, Gossypium raimondii
MATVAIERKQQASAEEMCTAKSGAKQGEGLRQYYLQHIHELQLNLRQKTHNLNRLEAQRNELNSRVRMLREELQLLQEPGSYVGEVVKVMGKNKVLVKVHPEGKYVVDIDKNIDITKITPSTRVALRNDSYVLHLILPSKVDPLVNLMKVEKVPDSTYDMIGGLDQQIKEIKEVIELPIKHPELFESLGIAQPKGVLLYGPPGTGKTLLARAVAHHTDCTFIRVSGSELVQKYIGEGSRMVRELFVMAREHAPSIIFMDEIDSIGSARMESGSGNGDSEVQRTMLELLNQLDGFEASNKIKVLMATNRIDILDQALLRPGRIDRKIEFPNPNEESRLDILKIHSRRMNLMRGIDLKKIAEKMNGASGAELKAVCTEAGMFALRERRVHVTQEDFEMAVAKVMKKETEKNMSLRKLWK

SEQ ID NO: 7695 - protein, 417 aa, Lippia dulcis
MATAAIESRQADDSKQQHRQGAGSGGGEGLRQYYQQRIQDMQLLVRQKVHDLQRLEAQRNDLNGRVRSLKEELQLLQEPGSYVGEVVKVMGKSKVLVKVHPEGKYVVDIDKSIDITKITPSTRVALRNDSYVLHLILPSKVDPLVNLMKVEKVPDSTYDMIGGLDQQIKEIKEVIELPIKHPELFESLGIAQPKGVLLYGPPGTGKTLLARAVAHHTDCTFIRVSGSELVQKYIGEGSRMVRELFVMAREHAPSIIFMDEIDSIGSARMESGSGNGDSEVQRTMLELLNQLDGFEASNKIKVLMATNRIDILDQALLRPGRIDRKIEFPNPNEESRFDILKIHSRKMNLMRGIDLKKIAEKMNGASGAELKAVCTEAGMFALRERRVHVTQEDFEMAVAKVMKKETEKNMSLRKLWK

SEQ ID NO: 7696 - protein, 416 aa, Platanus occidentalis
TAAIETKQAEAVAAEEMCSAKAMKQGEGLRQYYLQHIHDLQLQVRQKTHNLNRLEAQRNDLNSRVRMLREELQLLQEPGSYVGEVVKVMGKSKVLVKVHPEGKYVVDIDKNIDITKITPSTRVALRNDSYVLHLILPSKVDPLVNLMKVEKVPDSTYDMIGGLDQQIKEIKEVIELPIKHPELFESLGIAQPKGVLLYGPPGTGKTLLARAVAHHTDCTFIRVSGSELVQKYIGEGSRMVRELFVMAREHAPSIIFMDEIDSIGSTRMESGTGNGDSEVQRTMLELLNQLDGFEASNKIKVLMATNRIDILDQALLRPGRIDRKIEFPNPNEESRFDILKIHSRKMNLMRGIDLKKIAEKMNGASGAELKAVCTEAGMFALRERRVHVTQEDFEMAVAKVMKKETEKNMSLRKLWK

SEQ ID NO: 7697 - protein, 417 aa, Trigonella foenum-graecum
MATVGVEVKHAEGAPEEHCSAKPTKQGEGLRQYYTQHIHELQLLLRQKTHNLNRLEAQRNELNSRVRMLREELQLLQEPGSYVGEVVKVMGKNKVLVKVHPEGKYVVDIDKNIDITKITPSTRVALRNDSYVLHLVLPSKVDPLVNLMKVEKVPDSTYDMIGGLDQQIKEIKEVIELPIKHPELFESLGIAQPKGVLLYGPPGTGKTLLARAVAHHTDCTFIRVSGSELVQKYIGEGSRMVRELFVMAREHAPSIIFMDEIDSIGSARMESGSGNGDSEVQRTMLELLNQLDGFEASNKIKVLMATNRIDILDQALLRPGRIDRKIEFPNPNEESRRDILKIHSRRMNLMRGIDLKKIAEKMNGASGAELKAVCTEAGMFALRERRVHVTQEDFEMAVAKVMKKETEKNMSLRKLWK

SEQ ID NO: 7698 - protein, 417 aa, Centaurea maculosa
MATADIAMKAADSGEKHESCSSRAKQGDGLRQYYLQHIHDAQLQVRQKTHNLNRLEAQRNELNSRVRMLKEELQLLQEPGSYVGEVVKVMGKSKVLVKVHPEGKYVVDIDKSIDITKITPSTRVALRNDSYVLHLVLPSKVDPLVNLMKVEKVPDSTYDMIGGLDQQIKEIKEVIELPIKHPELFESLGIAQPKGVLLYGPPGTGKTLLARAVAHHTDCTFIRVSGSELVQKYIGEGSRMVRELFVMAREHAPSIIFMDEIDSIGSARMESGSGNGDSEVQRTMLELLNQLDGFEASNKIKVLMATNRIDILDQALLRPGRIDRKIEFPNPNEDSRFDILKIHSRKMNLMRGIDLKKIAEKMNGASGAELKAVCTEAGMFALRERRVHVTQEDFEMAVAKVMKKETEKNMSLRKLWK

SEQ ID NO: 7699 - protein, 419 aa, Unknown
  Sequence found in Organisms: Citrus clementina, Citrus sinensis
MAAVGIETKQPESAAPEEVCAAKGASKQGEGLRQYYLQHIHELQLQVRQKTHNLNRLEAQRNELNSRVRMLKEELQLLQEPGSYVGEVVKVMGKNKVLVKVHPEGKYVVDIDKSIDITKITPSTRVALRNDSYVLHLILPSKVDPLVNLMKVEKVPDSTYDMIGGLDQQIKEIKEVIELPIKHPELFESLGIAQPKGVLLYGPPGTGKTLLARAVAHHTDCTFIRVSGSELVQKYIGEGSRMVRELFVMAREHAPSIIFMDEIDSIGSARMESGSGNGDSEVQRTMLELLNQLDGFEASNKIKVLMATNRIDILDQALLRPGRIDRKIEFPNPNEESRLDILKIHSRRMNLMRGIDLKKIAEKMNGASGAELKAVCTEAGMFALRERRIHVTQEDFEMAVAKVMKKETEKNMSLRKLWK

SEQ ID NO: 7700 - protein, 418 aa, Lotus japonicus
MATVGVELNHAAEAAPEENCSAKPTKQGEGLRHYYSLHIHELQLLLRQKTHNLNRLEAQRNELNSRVRMLREELQLLQEPGSYVGEVVKVMGKNKVLVKVHPEGKYVVDIDKNIDITKITPSTRVALRNDSYVLHLVLPSKVDPLVNLMKVEKVPDSTYDMIGGLDQQIKEIKEVIELPIKHPELFESLGIAQPKGVLLYGPPGTGKTLLARAVAHHTDCTFIRVSGSELVQKYIGEGSRMVRELFVMAREHAPSIIFMDEIDSIGSARMESGSGNGDSEVQRTMLELLNQLDGFEASNKIKVLMATNRIDILDQALLRPGRIDRKIEFPNPNEESRQDILKIHSRRMNLMRGIDLKKIAEKMNGASGAELKAVCTEAGMFALRERRVHVTQEDFEMAVAKVMKKETEKNMSLRKLWK

SEQ ID NO: 7701 - protein, 401 aa, Pennisetum glaucum
AAAKGRSGGGGEGLRQYYLQHIHDLQLQIRQKTHNLNRLEAQRNDLNSRVRMLREELQLLQEPGSYVGEVVKVMGKSKVLVKVHPEGKYVVDIDKSIDITKITPSTRVALRNDSYMLHLVLPSKVDPLVNLMKVEKVPDSTYDMIGGLDQQIKEIKEVIELPIKHPELFESLGIAQPKGVLLYGPPGTGKTLLARAVAHHTDCTFIRVSGSELVQKYIGEGSRMVRELFVMAREHAPSIIFMDEIDSIGSARMESGTGNGDSEVQRTMLELLNQLDGFEASNKIKVLMATNRIDILDQALLRPGRIDRKIEFPNPNEDSRFDILKIHSRKMNLMRGIDLKKIAEKMNGASGAELKAVCTEAGMFALRERRVHVTQEDFEMAVAKVMKKDTEKNMSLRKLWK

SEQ ID NO: 7702 - protein, 417 aa, Mimulus guttatus
MATAAVENRQVEDPTAHRQQGGGAGGGEGLRQYYQQRIQDMQLLARQKNHDLQRLEAQRNNLNARVRSLKEELQLLQEPGSYVGEVVKVMGKSKVLVKVHPEGKYVVDIDKSIDITKITPSTRVALRNDSYVLHLVLPSKVDPLVNLMKVEKVPDSTYDMIGGLDQQIKEIKEVIELPIKHPELFESLGIAQPKGVLLYGPPGTGKTLLARAVAHHTDCTFIRVSGSELVQKYIGEGSRMVRELFVMAREHAPSIIFMDEIDSIGSARMESGSGNGDSEVQRTMLELLNQLDGFEASNKIKVLMATNRIDILDQALLRPGRIDRKIEFPNPNEDSRFDILKIHSRRMNLMRGIDLKKIAEKMNGASGAELKAVCTEAGMFALRERRVHVTQEDFEMAVAKVMKKETEKNMSLRKLWK

SEQ ID NO: 7703 - protein, 419 aa, Tropaeolum majus
MAAVGIDTKQPGLAAPEETCLAKAGSKQGEGLRQYYQQHILELHRLVRQKTHNLNRLEAQRNELNSRVRMLREELQLLQEPGSYVGEVVKVMGKNKVLVKVHPEGKYVVDIDKNIDITKITPSTRVALRNDSYVLHLVLPSKVDPLVNLMKVEKVPDSTYDMIGGLDQQIKEIKEVIELPIKHPELFESLGIAQPKGVLLYGPPGTGKTLLARAVAHHTDCTFIRVSGSELVQKYIGEGSRMVRELFVMAREHAPSIIFMDEIDSIGSARMESGSGNGDSEVQRTMLELLNQLDGFEASNKIKVLMATNRIDILDQALLRPGRIDRKIEFPNPNEESRQDILKIHSRRMNLMRGIDLKKIAEKMNGASGAELKAVCTEAGMFALRERRVHVTQEDFEMAVAKVMKKETEKNMSLRKLWK

SEQ ID NO: 7704 - protein, 419 aa, Tropaeolum majus
MATVGVEKKQPGSVVPDETCLARGGSKQGEGLRQYYLQHILELNRLVRQKTHNLNRLEAQRNELNSRVRMLREELQLLQEPGSYVGEVVKVMGKNKVLVKVHPEGKYVVDIDKSIDITKITPSTRVALRNDSYVLHLVLPSKVDPLVNLMKVEKVPDSTYDMIGGLDQQIKEIKEVIELPIKHPELFESLGIAQPKGVLLYGPPGTGKTLLARAVAHHTDCTFIRVSGSELVQKYIGEGSRMVRELFVMAREHAPSIIFMDEIDSIGSARMESGSGNGDSEVQRTMLELLNQLDGFEASNKIKVLMATNRIDILDQALLRPGRIDRKIEFPNPNEESRQDILKIHSRRMNLMRGIDLKKIAEKMNGASGAELKAVCTEAGMFALRERRVHVTQEDFEMAVAKVMKKETEKNMSLRKLWK

SEQ ID NO: 7705 - protein, 420 aa, Arnica chamissonis
MATAEIAMKPADSGQKDESCSSKHMAAKPGEGLKQYYQQHIHDSQLQARQKTHNLNRLEAQRNELNSRVRMLKEELQLLQEPGSYVGEVVKVMGKSKVLVKVHPEGKYVVDIDKSIDITKITPSTRVALRNDSYVLHLVLPSKVDPLVNLMKVEKVPDSTYDMIGGLDQQIKEIKEVIELPIKHPELFESLGIAQPKGVLLYGPPGTGKTLLARAVAHHTDCTFIRVSGSELVQKYIGEGSRMVRELFVMAREHAPSIIFMDEIDSIGSARMESGSGNGDSEVQRTMLELLNQLDGFEASNKIKVLMATNRIDILDQALLRPGRIDRKIEFPNPNEDSRFDILKIHSRRMNLMRGIDLKKIAEKMNGASGAELKAVCTEAGMFALRERRVHVTQEDFEMAVAKVMKKETEKNMSLRKLWK

SEQ ID NO: 7706 - protein, 270 aa, Brassica napus
MKVEKVPDSTYDMIGGLDQQIKEIKEVIELPIKHPELFESLGIAQPKGVLLYGPPGTGKTLLARAVAHHTDCTFIRVSGSELVQKYIGEGSRMVRELFVMAREHAPSIIFMDEIDSIGSARMESGSGNGDSEVQRTMLELLNQLDGFEASNKIKVLMATNRIDILDQALLRPGRIDRKIEFPNPNEDSRCDILKIHSRKMNLMRGIDLKKIAEKMNGASGAELKAVCTEAGMFALRERRVHVTQEDFEMAVAKVMKKDTEKNMSLRKLWK

SEQ ID NO: 7707 - protein, 419 aa, Brassica napus
MAAVGVEARRPETAMEETCNAKGAVAKQGEGLKQYYLQHIHELQRQLRQKTNNLNRLEAQRNELNSRVRMLREELQLLQEPGSYVGEVVKVMGKNKVLVKVHPEGKYVVDIDKSIDINKITPSTRVALRNDSYVLHLVLPSKVDPLVNLMKVEKVPDSTYDMIGGLDQQIKEIKEVIELPIKHPELFESLGIAQPKGVLLYGPPGTGKTLLARAVAHHTDCTFIRVSGSELVQKYIGEGSRMVRELFVMAREHAPSIIFMDEIDSIGSARMESGSGNGDSEVQRTMLELLNQLDGFEASNKIKVLMATNRIDILDQALLRPGRIDRKIEFPNPNEDSRFDILKIHSRKMNLMRGIDLKKIAEKMNGASGAELKAVCTEAGMFALRERRVHVTQEDFEMAVAKVMKKDTEKNMSLRKLWK

SEQ ID NO: 7708 - protein, 419 aa, Unknown
  Sequence found in Organisms: Brassica napus, Brassica rapa
MAAVGIETRRPEGAMEETCHVKGAVAKQGEGLKQYYLQHIDELQRLLRHKTNNLNRLEAQRNDLNSRVRMLREELQLLQEPGSYVGEVVKVMGKNKVLVKVHPEGKYVVDIDKSIDITKLTPSTRVALRNDSYVLHLVLPSKVDPLVNLMKVEKVPDSTYDMIGGLDQQIKEIKEVIELPIKHPELFESLGIAQPKGVLLYGPPGTGKTLLARAVAHHTDCTFIRVSGSELVQKYIGEGSRMVRELFVMAREHAPSIIFMDEIDSIGSARMESGSGNGDSEVQRTMLELLNQLDGFEASNKIKVLMATNRIDILDQALLRPGRIDRKIEFPNPNEDSRCDILKIHSRKMNLMRGIDLKKIAEKMNGASGAELKAVCTEAGMFALRERRVHVTQEDFEMAVAKVMKKDTEKNMSLRKLWK

SEQ ID NO: 7709 - protein, 417 aa, Cicer arietinum
MAAVGVEVKHAEGAPEEHCSAKPTKQGEGLRQYYTQHIHELQLLLRQKTHNLNRLEAQRNELNSRVRMLREELQLLQEPGSYVGEVVKVMGKNKVLVKVHPEGKYVVDIDKNIDITKITPSTRVALRNDSYVLHLVLPSKVDPLVNLMKVEKVPDSTYDMIGGLDQQIKEIKEVIELPIKHPELFESLGIAQPKGVLLYGPPGTGKTLLARAVAHHTDCTFIRVSGSELVQKYIGEGSRMVRELFVMAREHAPSIIFMDEIDSIGSARMESGSGNGDSEVQRTMLELLNQLDGFEASNKIKVLMATNRIDILDQALLRPGRIDRKIEFPNPNEESRRDILKIHSRRMNLMRGIDLKKIAEKMNGASGAELKAVCTEAGMFALRERRVHVTQEDFEMAVAKVMKKETEKNMSLRKLWK

SEQ ID NO: 7710 - protein, 420 aa, Flaveria ramosissima
MATVDVAMKPSDSVDRDDNCSSRPTTAKSGEGLRQYYLQHIHDAQLQVRQKTHNLNRLEAQRNELNSRVRMLKEELQLLQEPGSYVGEVVKVMGKSKVLVKVHPEGKYVVGIDKSIDITKITPSTRVALRNDSYVLHLVLPSKVDPLVNLMKVEKVPDSTYDMIGGLDQQIKEIKEVIELPIKHPELFESLGIAQPKGVLLYGPPGTGKTLLARAVAHHTDCTFIRVSGSELVQKYIGEGSRMVRELFVMAREHAPSIIFMDEIDSIGSARMESGSGNGDSEVQRTMLELLNQLDGFEASNKIKVLMATNRIDILDQALLRPGRIDRKIEFPNPNEDSRFDILKIHSRKMNLMRGIDLKKIAEKMNGASGAELKAVCTEAGMFALRERRVHVTQEDFEMAVAKVMKKETEKNMSLRKLWK

SEQ ID NO: 7711 - protein, 417 aa, Lippia dulcis
MATAAIIARQADEAKRQHQQGAASGGGEGLRQYYQQTIQDLQLLSRQKHHDLQRLEAQRNDLNARVRSLKEELQLLQEPGSYVGEVVKVMGKSKVLVKVHPEGKYVVDIDKSIDITKITPSTRVALRNDSYVLHLVLPSKVDPLVNLMKVEKVPDSTYDMIGGLDQQIKEIKEVIELPIKHPELFESLGIAQPKGVLLYGPPGTGKTLLARAVAHHTDCTFIRVSGSELVQKYIGEGSRMVRELFAMAREHAPSIIFMDEIDSIGSARMESGSGNGDSEVQRTMLELLNQLDGFEASNKIKVLMATNRIDILDQALLRPGRIDRKIEFPNPNEESRWDILKIHSRKMNLMRGIDLKKIAEKMNGASGAELKAVCTEAGMFALRERRVHVTQEDFEMAVAKVMKKETEKNMSLRKLWK

SEQ ID NO: 7712 - protein, 420 aa, Helianthus annuus
MASVDVAMKPSDSVDRDENCSSRSSTAKSGEGLRQYYLQHIHDAQLQVRQKTHNLNRLEAQRNELNSRVRMLKEELQLLQEPGSYVGEVVKVMGKSKVLVKVHPEGKYVVDIDKSIDITKITPSTRVALRNDSYVLHLVLPSKVDPLVNLMKVEKVPDSTYDMIGGLDQQIKEIKEVIELPIKHPELFESLGIAQPKGVLLYGPPGTGKTLLARAVAHHTDCTFIRVSGSELVQKYIGEGSRMVRELFVMAREHAPSIIFMDEIDSIGSARMESGSGNGDSEVQRTMLELLNQLDGFEASNKIKVLMATNRIDILDQALLRPGRIDRKIEFPNPNEDSRFDILKIHSRKMNLMRGIDLKKIAEKMNGASGAELKAVCTEAGMFALRERRVHVTQEDFEMAVAKVMKKETEKNMSLRKLWK

SEQ ID NO: 7713 - protein, 419 aa, Vinca minor
MATAQIETNRRESEREESCSAKGSMAKQGQGLRQYYTQHIHDLQLQVRQKTHNLNRLEAQRNDLNSKVRMLKEELQLLQEPGSYVGEVVKVMGKSKVLVKVHPEGKYVVDIDKSIDITKITTSTRVALRNDSYVLHLILPSKVDPLVNLMKVEKVPDSTYDMIGGLDQQIKEIKEVIELPIKHPELFESLGIAQPKGVLLYGPPGTGKTLLARAVAHHTDCTFIRVSGSELVQKYIGEGSRMVRELFVMAREHAPSIIFMDEIDSIGSARMESGSGNGDSEVQRTMLELLNQLDGFEASNKIKVLMATNRIDILDQALLRPGRIDRKIEFPNPNEESRFDILKIHSRKMNLMRGIDLKKIAEKMNGASGAELKAVCTEAGMFALRERRVHVTQEDFEMAVAKVMKKDTEKNMSLRKLWK

SEQ ID NO: 7714 - protein, 418 aa, Citrullus lanatus
MATMEVETQQPTSASFDTCSAKQATKQGEGLRQYYLQHIHELQLQVRQKTHNLNRLEAQRNELNSKVRMLREELQLLQEPGSYVGEVVKVMGKNKVLVKVHPEGKYVVDIDKSIDITKITPSTRVALRNDSYVLHLVLPSKVDPLVNLMKVEKVPDSTYDMIGGLDQQIKEIKEVIELPIKHPELFESLGIAQPKGVLLYGPPGTGKTLLARAVAHHTDCTFIRVSGSELVQKYIGEGSRMVRELFVMAREHAPSIIFMDEIDSIGSARMESGSGNGDSEVQRTMLELLNQLDGFEASNKIKVLMATNRIDILDQALLRPGRIDRKIEFPNPNEDSRFDILKIHSRKMNLMRGIDLKKIAEKMNGASGAELKAVCTEAGMFALRERRVHVTQEDFEMAVAKVMKKESEKNMSLRKLWK

SEQ ID NO: 7715 - protein, 419 aa, Arabidopsis thaliana
MAAVGVDSRRPETAMEETCNVKGAAAKQGEGLKQYYLQHIHELQRQLRQKTNNLNRLEAQRNELNSRVRMLREELQLLQEPGSYVGEVVKVMGKNKVLVKVHPEGKYVVDIDKSIDITKITPSTRVALRNDSYVLHLVLPSKVDPLVNLMKVEKVPDSTYDMIGGLDQQIKEIKEVIELPIKHPELFESLGIAQPKGVLLYGPPGTGKTLLARAVAHHTDCTFIRVSGSELVQKYIGEGSRMVRELFVMAREHAPSIIFMDEIDSIGSARMESGSGNGDSEVQRTMLELLNQLDGFEASNKIKVLMATNRIDILDQALLRPGRIDRKIEFPNPNEESRFDILKIHSRKMNLMRGIDLKKIAEKMNGASGAELKAVCTEAGMFALRERRVHVTQEDFEMAVAKVMKKDTEKNMSLRKLWK

SEQ ID NO: 7716 - protein, 416 aa, Brassica oleracea
MAAVGIETRRPEGAMEETCNVKGAQGEGLKQYYLQHIDELQRLLRQKTNNLNRLEAQRNDLNSRVRMLREELQLLQEPGSYVGEVVKVMGKNKVLVKVHPEGKYVVDIDKSIDITKLTPSTRVALRNDSYVLHLVLPSKVDPLVNLMKVEKVPDSTYDMIGGLDQQIKEIKEVIELPIKHPELFESLGIAQPKGVLLYGPPGTGKTLLARAVAHHTDCTFIRVSGSELVQKYIGEGSRMVRELFVMAREHAPSIIFMDEIDSIGSARMESGSGNGDSEVQRTMLELLNQLDGFEASNKIKVLMATNRIDILDQALLRPGRIDRKIEFPNPNEDSRCDILKIHSRKMNLMRGIDLKKIAEKMNGASGAELKAVCTEAGMFALRERRVHVTQEDFEMAVAKVMKKDTEKNMSLRKLWK

SEQ ID NO: 7717 - protein, 270 aa, Musa acuminata
MKVEKVPDSTYDMIGGLEQQIKEIKEVIELPIKHPELFESLGIAQPKGVLLYGPPGTGKTLLARAVAHHTDCTFIRVSGSELVQKYIGEGSRMVRELFVMAREHAPSIIFMDEIDSIGSARMESGTGNGDSEVQRTMLELLNQLDGFEASNKIKVLMATNRIDILDQALLRPGRIDRKNEFPNPKEEFRLDILKIHSRKMNLMRGIDLKKIAEKMNGASGAELKAVCTEAGMFALRERRVHVTQEDFEMAVAKVMKKETEKNMSLRKLWK

SEQ ID NO: 7718 - protein, 419 aa, Brassica napus
MAAVGVEARRPETAMEETCNAKGAVAKQGEGLKQYYLQHIHELQRLLRQKTNNLNRLEAQRNELNSRVRMLREELQLLQEPGSYVGEVVKVMGKNKVLVKVHPEGKYVVDIDKSIDINKITPSTRVALRNDSYVLHLVLPSKVDPLVNLMKVEKVPDSTYDMIGGLDQQIKEIKEVIELPIKHPELFESLGIAQPKGVLLYGPPGTGKTLLARAVAHHTDCTFIRVSGSELVQKYIGEGSRMVRELFVMAREHAPSIIFMDEIDSIGSARMESGSGNGDSEVQRTMLELLNQLDGFEASNKIKVLMATNRIDILDQALLRPGRIDRKIEFPNPNEDSRFDILKIHSRKMNLMRGIDLKKIAEKMNGASGAELKAVCTEAGMFALRERRVHVTQEDFEMAVAKVMKKDTEKNMSLRKLWK

SEQ ID NO: 7719 - protein, 417 aa, Gossypium hirsutum
MATVAIERKQQASAEEMCTAKSGAKQGEGLRQYYLQHIHELQLNLRQKTHNLNRLEAQRNELNSRVRMLREELQLLQEPGSYVGEVVKVMGKNKVLVKVHPEGKYVVDIDKNIDITKITPSTRVALRNDSYVLHLILPSKVDPLVNLMKVEKVPDSTFDMIGGLDQQIKEIKEVIELPIKHPELFESLGIAQPKGVLLYGPPGTGKTLLARAVAHHTDCTFIRVSGSELVQKYIGEGSRMVRELFVMAREHAPSIIFMDEIDSIGSARMESGSGNGDSEVQRTMLELLNQLDGFEASNKIKVLMATNRIDILDQALLRPGRIDRKIEFPNPNEESRLDILKIHSRRMNLMRGIDLKKIAEKMNGASGAELKAVCTEAGMFALRERRVHVTQEDFEMAVAKVMKKETEKNMSLRKLWK

SEQ ID NO: 7720 - protein, 417 aa, Medicago truncatula
MAAVGVEVKHAEGAPEEHCSAKPTKQGEGLRQYYTQHIHELQLLQRQKTHNLNRLEAQRNELNSRVRMLREELQLLQEPGSYVGEVVKVMGKNKVLVKVHPEGKYVVDIDKNIDITKITPSTRVALRNDSYVLHLVLPSKVDPLVNLMKVEKVPDSTYDMIGGLDQQIKEIKEVIELPIKHPELFESLGIAQPKGVLLYGPPGTGKTLLARAVAHHTDCTFIRVSGSELVQKYIGEGSRMVRELFVMAREHAPSIIFMDEIDSIGSARMESGSGNGDSEVQRTMLELLNQLDGFEASNKIKVLMATNRIDILDQALLRPGRIDRKIEFPNPNEESRRDILKIHSRRMNLMRGIDLKKIAEKMNGASGAELKAVCTEAGMFALRERRVHVTQEDFEMAVAKVMKKETEKNMSLRKLWK

SEQ ID NO: 7721 - protein, 418 aa, Cucumis melo
MATMEVETQKVASASLDACSAKQATKQGEGLRQYYLQHIHELQLQVRQKTHNLNRLEAQRNELNSKVRMLREELQLLQEPGSYVGEVVKVMGKNKVLVKVHPEGKYVVDIDKSIDITKITPSTRVALRNDSYVLHLVLPSKVDPLVNLMKVEKVPDSTYDMIGGLDQQIKEIKEVIELPIKHPELFESLGIAQPKGVLLYGPPGTGKTLLARAVAHHTDCTFIRVSGSELVQKYIGEGSRMVRELFVMAREHAPSIIFMDEIDSIGSARMESGSGNGDSEVQRTMLELLNQLDGFEASNKIKVLMATNRIDILDQALLRPGRIDRKIEFPNPNEDSRFDILKIHSRKMNLMRGIDLKKIAEKMNGASGAELKAVCTEAGMFALRERRVHVTQEDFEMAVAKVMKKESEKNMSLRKLWK

SEQ ID NO: 7722 - protein, 246 aa, Cucumis melo
MATMELDTKLPEAINEEACSAKPATKHGEGLRHYYLQHIQDLQLQLRLKTHNLNRLEAQRNELNSRVRLLREELQLLQEPGSYVGEVVKVMGKNKVLVKVHPEGKYVVDIDKSIDITKITPSTRVALRNDSYVLHLVLPSKVDPLVNLMKVEKVPDSTYDMIGGLDQQIKEIKEVIELPIKHPELFESLGIAQPKGVLLYGPPGTGKTLLARAVAHHTDCTFIRVSGSELVQKYIGEGSRMVRELL

SEQ ID NO: 7723 - protein, 427 aa, Populus trichocarpa
MATVGVERRQQQQQTESTMTMTAEESCLAKTGAAKQGEGLKQYYIQHIHELLLHVRQKTHNLNRLEAQRNDINSRVRMLREELQLLQEPGSYVGEVVKVMGKNKVLVKVHPEGKYVVDIDKSIDITKITPSTRVALRNDSYVLHLILPSKVDPLVNLMKVEKVPDSTYDMIGGLDQQIKEIKEVIELPIKHPELFESLGIAQPKGVLLYGPPGTGKTLLARAVAHHTDCTFIRVSGSELVQKYIGEGSRMVRELFVMAREHAPSIIFMDEIDSIGSARMESGSGNGDSEVQRTMLELLNQLDGFEASNKIKVLMATNRIDILDQALLRPGRIDRKIEFPNPNEDSRCDILKIHSRRMNLMRGIDLKKIAGKMNGASGAELKAVCTEAGMFALRERRVHVTQEDFEMAVAKVMKKETEKNMSLRKLWK

SEQ ID NO: 7724 - protein, 260 aa, Momordica charantia
MATMEVENQQATLASVDTCSAKQATKQGEGLRQYYLQHIHELQLQVRQKTHNLNRLEAQRNELNSKVRMLREELQLLQEPGSYVGEVVKVMGKNKVLVKVHPEGKYVVDIDKSIDITKITPSTRVALRNDSYVLHLILPSKVDPLVNLMKVEKVPDSTYDMIGGLDQQIKEIKEVIELPIKHPELFESLGIAQPKGVLLYGPPGTGKTLLARAVAHHTDCTFIRVSGSELVQKYIGEGSRMVRELFCYGQGACSFNHFHG

SEQ ID NO: 7725 - protein, 422 aa, Amsonia hubrichtii
MAAATIESNFPAEEAKGVLKHYHQQQQASADGEGLRHYYLLRIHDLQLQVRQKTDDLQRLEAQRNELNSRVRMLKEELQLLQEPGSYVGEVVKVMGKSKVLVKVHPEGKYVVDIDKNIDITKLTPSTRVALRNDSYMLHLILPSKVDPLVNLMKVEKVPDSTYDMIGGLDQQIKEIKEVIELPIKHPELFESLGIAQPKGVLLYGPPGTGKTLLARAVAHHTDCTFIRVSGSELVQKYIGEGSRMVRELFVMAREHAPSIIFMDEIDSIGSARMESGSGNGDSEVQRTMLELLNQLDGFEASNKIKVLMATNRIDILDQALLRPGRIDRKIEFPNPNEESRFDILKIHSRRMNLMRGIDLKKIAEKMTGASGAELKAVCTEAGMFALRERRVHVTQEDFEMAVGKVMKKDTEKNMSLRKLWK

SEQ ID NO: 7726 - protein, 419 aa, Amsonia hubrichtii
MATAEIEANRSEVERGESCSAKGSMVKQGEGLRQYYLQHIHDLQLQVRQKTHNLNRLEAQRNELNSKVRMLKEELQLLQEPGSYVGEVVKVMGKSKVLVKVHPEGKYVVDIDKSIDITKITPSTRVALRNDSYVLHLVLPSKVDPLVNLMKVEKVPDSTYDMIGGLDQQIKEIKEVIELPIKHPELFESLGIAQPKGVLLYGPPGTGKTLLARAVAHHTDCTFIRVSGSELVQKYIGEGSRMVRELFVMAREHAPSIIFMDEIDSIGSARMESGSGNGDSEVQRTMLELLNQLDGFEASNKIKVLMATNRIDILDHALLRPGRIDRKIEFPNPNEDSRFDILKIHSRKMNLMRGIDLKKIAEKMNGASGAELKAVCTEAGMFALRERRVHVTQEDFEMAVAKVMKKETEKNMSLRKLWK

SEQ ID NO: 7727 - protein, 420 aa, Arnica chamissonis
MASVDVAMKPSDSVDRDENCSSRPTTAKPGEGLRQYYLQHIHDAQLQVRQKTHNLNRLEAQRNELNSRVRMLKEELQLLQEPGSYVGEVVKVMGKSKVLVKVHPEGKYVVDIDKSIDITKITPSTRVALRNDSYVLHLVLPSKVDPLVNLMKVEKVPDSTYDMIGGLDQQIKEIKEVIELPIKHPELFESLGIAQPKGVLLYGPPGTGKTLLARAVAHHTDCTFIRVSGSELVQKYIGEGSRMVRELFVMAREHAPSIIFMDEIDSIGSARMESGSGNGDSEVQRTMLELLNQLDGFEASNKIKVLMATNRIDILDQALLRPGRIDRKIEFPNPNEDSRCDILKIHSRRMNLMRGIDLKKIAEKMNGASGAELKAVCTEAGMFALRERRVHVTQEDFEMAVAKVMKKESEKNMSLRKLWK

SEQ ID NO: 7728 - protein, 420 aa, Cirsium arvense
MASVEIAMKLSDSENRDENCSSRPTTAKTGEGLRQYYLQHIHDAQLQVRQKTHNLNRLEAQRNDLNSRVRMLKEELQLLQEPGSYVGEVVKVMGKSKVLVKVHPEGKYVVDIDKSIDITKITPSTRVALRNDSYVLHLVLPSKVDPLVNLMKVEKVPDSTYDMIGGLDQQIKEIKEVIELPIKHPELFESLGIAQPKGVLLYGPPGTGKTLLARAVAHHTDCTFIRVSGSELVQKYIGEGSRMVRELFVMAREHAPSIIFMDEIDSIGSARMESGSGNGDSEVQRTMLELLNQLDGFEASNKIKVLMATNRIDILDQALLRPGRIDRKIEFPNPNEDSRFDILKIHSRKMNLMRGIDLKKIAEKMNGASGAELKAVCTEAGMFALRERRVHVTQEDFEMAVAKVMKKETEKNMSLRKLWK

SEQ ID NO: 7729 - protein, 420 aa, Helianthus annuus
MASVDVAMKPSDSVDRDENCSSRSSTAKSGEGLRQYYLQHIHDSQLQVRQKTHNLNRLEAQRNELNSRVRMLKEELQLLQEPGSYVGEVVKVMGKSKVLVKVHPEGKYVVDIDKSIDITKITPSTRVALRNDSYVLHLVLPSKVDPLVNLMKVEKVPDSTYDMIGGLDQQIKEIKEVIELPIKHPELFESLGIAQPKGVLLYGPPGTGKTLLARAVAHHTDCTFIRVSGSELVQKYIGEGSRMVRELFVMAREHAPSIIFMDEIDSIGSARMESGSGNGDSEVQRTMLELLNQLDGFEASNKIKVLMATNRIDILDQALLRPGRIDRKIEFPNPNEDSRFDILKIHSRKMKLMRGIDLKKIAEKMNGASGAELKAVCTEAGMFALRERRVHVTQEDFEMAVAKVMKKETEKNMSLRKLWK

SEQ ID NO: 7730 - protein, 418 aa, Citrullus lanatus
MATMELDSKLPEATIEETCSAKPATKHGEGLRHYYLQHIQELQLQLRLKTHNLNRLEAQRNELNSRVRLLREELQLLQEPGSYVGEVVKVMGKNKVLVKVHPEGKYVVDIDKSIDITKITPSTRVALRNDSYVLHLVLPSKVDPLVNLMKVEKVPDSTYDMIGGLDQQIKEIKEVIELPIKHPELFESLGIAQPKGVLLYGPPGTGKTLLARAVAHHTDCTFIRVSGSELVQKYIGEGSRMVRELFVMAREHAPSIIFMDEIDSIGSARMESGTGNSDSEVQRTMLELLNQLDGFEASNKIKVLMATNRIDILDQALLRPGRIDRKIEFPNPNEESRFDILKIHSRKMNLMRGIDLKKIAEKMNGASGAELKAVCTEAGMFALRERRVHVTQEDFEMAVAKVMKKDTDKNMSLRKLWK

SEQ ID NO: 7731 - protein, 419 aa, Arabidopsis thaliana
MAAVGVEARPPVTAMEETCNVKGAAAKQGEGLNKYYLQHLDELQRLQREKSYNLNRLEAQRNELNSRVRMLREELQLLQEPGSYVGEVVKVMGKNKVLVKVHPEGKYVVDIDKSIDITKLTPSTRVALRNDSYVLHLVLPSKVDPLVNLMKVEKVPDSTYDMIGGLDQQIKEIKEVIELPIKHPELFESLGIAQPKGVLLYGPPGTGKTLLARAVAHHTDCTFIRVSGSELVQKYIGEGSRMVRELFVMAREHAPSIIFMDEIDSIGSARMESGSGNGDSEVQRTMLELLNQLDGFEASNKIKVLMATNRIDILDQALLRPGRIDRKIEFPNPNEESRFDILKIHSRKMNLMRGIDLKKIAEKMNGASGAELKAVCTEAGMFALRERRVHVTQEDFEMAVAKVMKKDTEKNMSLRKLWK

SEQ ID NO: 7732 - protein, 419 aa, Brassica rapa
MAAVGVEARRPETAMEETCNAKGAVAKQGEGLKQYYLQHIHELQRLLRQKTNNLNRLEAQRNELNSRVRMLREELQLLQEPGSYVGEVVKVMGKNKVLVKVHPEGKYVVDIDKSIDINKITPSTRVALRNDSYVLHLVLPSKVDPLVNLMKVEKVPDSTYDMIGGLDQQIKEIKEVIELPIKHPELFESLGIAQPKGVLLYGPPGTGKTLLARAVAHHTDCTFIRVSGSELVQKYIGEGSRMVRELFVMAREHAPSIIFMDEIDSIGSARMESGSGNGDSEVQRTMLELLNQLDGFEASNKIKVLMATNRIDILDQALLRPGRIDRKIEFPNPNEDSRFDILKIHSRKMNLMRGIDLKKIAEKMNGASGAELKAVCTEAGMFALRERRVHVTQEDVEMAVAKVMKKDTEKNMSLRKLWK

SEQ ID NO: 7733 - protein, 418 aa, Cucumis sativus
MAIMEVETQQAASASLDACSAKQATKQGEGLRQYYLQHIHEHQLQVRQKTHNLNRLEAQRNELNSKVRMLREELQLLQEPGSYVGEVVKVMGKNKVLVKVHPEGKYVVDIDKSIDITKITPSTRVALRNDSYVLHLVLPSKVDPLVNLMKVEKVPDSTYDMIGGLDQQIKEIKEVIELPIKHPELFESLGIAQPKGVLLYGPPGTGKTLLARAVAHHTDCTFIRVSGSELVQKYIGEGSRMVRELFVMAREHAPSIIFMDEIDSIGSARMESGSGNGDSEVQRTMLELLNQLDGFEASNKIKVLMATNRIDILDQALLRPGRIDRKIEFPNPNEDSRFDILKIHSRKMNLMRGIDLKKIAEKMNGASGAELKAVCTEAGMFALRERRVHVTQEDFEMAVAKVMKKESEKNMSLRKLWK

SEQ ID NO: 7734 - protein, 418 aa, Cucumis sativus
MATMELDTKLPEAISEDTCSAKPATKHGEGLRHYYLQHIQDLQLQLRLKTHNLNRLEAQRNELNSRVRLLREELQLLQEPGSYVGEVVKVMGKNKVLVKVHPEGKYVVDIDKSIDITKITPSTRVALRNDSYVLHLVLPSKVDPLVNLMKVEKVPDSTYDMIGGLDQQIKEIKEVIELPIKHPELFESLGIAQPKGVLLYGPPGTGKTLLARAVAHHTDCTFIRVSGSELVQKYIGEGSRMVRELFVMAREHAPSIIFMDEIDSIGSARMESGSGNSDSEVQRTMLELLNQLDGFEASNKIKVLMATNRIDILDQALLRPGRIDRKIEFPNPNEESRFDILKIHSRKMNLMRGIDLKKIAEKMNGASGAELKAVCTEAGMFALRERRVHVTQEDFEMAVAKVMKKDTDKNMSLRKLWK

SEQ ID NO: 7735 - protein, 419 aa, Eschscholzia californica
MATAAVETTKQPETGSDIYSASRTMVKQGEGLKQYYSQRIHDYQLQVRQKTHNLNRLEAQRNDLNSRVRMLREELQLLQEPGSYVGEVVKVMGKSKVLVKVHPEGKYVVDVDKSIDITKITPTTRVALRNDSYMLHLILPSKVDPLVNLMKVEKVPDSTYDMIGGLDQQIKEIKEVIELPIKHPELFESLGIAQPKGVLLYGPPGTGKTLLARAVAHHTDCTFIRVSGSELVQKYIGEGSRMVRELFVMAREHAPSIIFMDEIDSIGSARMESGSGNGDSEVQRTMLELLNQLDGFEASNKIKVLMATNRIDILDQALLRPGRIDRKIEFPNPNADSRWDILKIHSRKMNLMRGIDLKKIAEKMNGASGAELKAVCTEAGMFALRERRVHVTQEDFEMAVGKVMKKETEKNMSLRKLWK

SEQ ID NO: 7736 - protein, 426 aa, Eucalyptus grandis
MAATAFDKPQPELAPPPSAEEGACNSTRGPGAAKHGEGLRQYYLQHTHELQLLVRQKTHNLNRLEAQRNELNSRVRMLREELQLLQEPGSYVGEVVKVMGKNKVLVKVHPEGKYVVDIDKNIDITKITPSTRVALRNDSYVLHLILPSKVDPLVNLMKVEKVPDSTYDMIGGLDQQIKEIKEVIELPIKHPELFESLGIAQPKGVLLYGPPGTGKTLLARAVAHHTDCTFIRVSGSELVQKYIGEGSRMVRELFVMAREHAPSIIFMDEIDSIGSARMESGSGNGDSEVQRTMLELLNQLDGFEASNKIKVLMATNRIDILDQALLRPGRIDRKIEFPNPNEESRLDILKIHSRKMNLMRGIDLKKIAEKMNGASGAELKAVCTEAGMFALRERRVHVTQEDFEMAVAKVMKKETEKNMSLRKLWK

SEQ ID NO: 7737 - protein, 411 aa, Euphorbia peplus
MIVDESCSAKSSGAAAAGKLGEGLRQYYLQHIHELHLLVRQKSHNLNRLEAQRNELNSRVRMLREELQLLQEPGSYVGEVVKVMGKNKVLVKVHPEGKYVVDIDKSIDITKITPSTRVALRNDSYVLHLVLPSKVDPLVNLMKVEKVPDSTYDMIGGLDQQIKEIKEVIELPIKHPELFESLGIAQPKGVLLYGPPGTGKTLLARAVAHHTDCTFIRVSGSELVQKYIGEGSRMVRELFVMAREHAPSIIFMDEIDSIGSARMESGSGNGDSEVQRTMLELLNQLDGFEASNKIKVLMATNRIDILDQALLRPGRIDRKIEFPNPNEESRQDILKIHSRRMNLMRGIDLKKIAEKMNGASGAELKAVCTEAGMFALRERRVHVTQEDFEMAVAKVMKKETEKNMSLRKLWK

SEQ ID NO: 7738 - protein, 417 aa, Cajanus cajan
MAAVGVELKHAESAPEENCSAKPTKQGEGLRQYYALHIHEHQLLLRQKTHNLNRLEAQRNELNSRVRMLREELQLLQEPGSYVGEVVKVMGKNKVLVKVHPEGKYVVDIDKNIDITKITPSTRVALRNDSYVLHLILPSKVDPLVNLMKVEKVPDSTYDMIGGLDQQIKEIKEVIELPIKHPELFESLGIAQPKGVLLYGPPGTGKTLLARAVAHHTDCTFIRVSGSELVQKYIGEGSRMVRELFVMAREHAPSIIFMDEIDSIGSARMESGSGNGDSEVQRTMLELLNQLDGFEASNKIKVLMATNRIDILDQALLRPGRIDRKIEFPNPNEESRLDILKIHSRRMNLMRGIDLKKIAEKMNGASGAELKAVCTEAGMFALRERRVHVTQEDFEMAVAKVMKKETEKNMSLRKLWK

SEQ ID NO: 7739 - protein, 419 aa, Cichorium intybus
MATAEIAMTPADSLEKDEGCSTRHTAKPGEGLRQYYLQHIHDAQLQVRQKSHNLNRLEAQRNELNSRVRMLKEELQLLQEPGSYVGEVVKVMGKSKVLVKVHPEGKYVVDIDKSIDITKITPSTRVALRNDSYVLHLVLPSKVDPLVNLMKVEKVPDSTYDMIGGLDQQIKEIKEVIELPIKHPELFESLGIAQPKGVLLYGPPGTGKTLLARAVAHHTDCTFIRVSGSELVQKYIGEGSRMVRELFVMAREHAPSIIFMDEIDSIGSARMESGSGNGDSEVQRTMLELLNQLDGFEASNKIKVLMATNRIDILDQALLRPGRIDRKIEFPNPNEDSRWDILKIHSRKMNLMRGIDLKKIAEKMNGASGAELKAVCTEAGMFALRERRVHVTQEDFEMAVAKVMKKETEKNMSLRKLWK

SEQ ID NO: 7740 - protein, 420 aa, Coffea canephora
MATAEVEKNRSGAEREESCSSKGTMMVKQGEGLRQYYLQHIHDLQLQVRQKSHNLNRLEAQRNELNSKVRMLKEELQLLQEPGSYVGEVVKVMGKSKVLVKVHPEGKYVVDIDKNIDITKITPSTRVALRNDSYVLHLILPSKVDPLVNLMKVEKVPDSTYDMIGGLDQQIKEIKEVIELPIKHPELFESLGIAQPKGVLLYGPPGTGKTLLARAVAHHTDCTFIRVSGSELVQKYIGEGSRMVRELFVMAREHAPSIIFMDEIDSIGSARMESGSGNGDSEVQRTMLELLNQLDGFEASNKIKVLMATNRIDILDQALLRPGRIDRKIEFPNPNEESRFDILKIHSRKMNLMRGIDLKKIAEKMNGASGAELKAVCTEAGMFALRERRVHVTQEDFEMAVAKVMKKETEKNMSLRKLWK

SEQ ID NO: 7741 - protein, 417 aa, Unknown
  Sequence found in Organisms: Solanum tuberosum, Solanum phureja
MASVDVEKSRSDMEREEACSAKPTKQGEGLRQYYMQHIHDLQLQVRVKTHNLNRLEAQRNELNSKVRMLKEELQLLQEPGSYVGEVVKVMGKSKVLVKVHPEGKYVVDIGKNIDITKITPSTRVALRNDSYVLHLILPSKVDPLVNLMKVEKVPDSTYDMIGGLDQQIKEIKEVIELPIKHPELFESLGIAQPKGVLLYGPPGTGKTLLARAVAHHTDCTFIRVSGSELVQKYIGEGSRMVRELFVMAREHAPSIIFMDEIDSIGSARMESGSGNGDSEVQRTMLELLNQLDGFEASNKIKVLMATNRIDILDQALLRPGRIDRKIEFPNPNEESRQDILKIHSRKMNLMRGIDLKKIAEKMSGASGAELKAVCTEAGMFALRERRVHVTQEDFEMAVAKVMKKETEKNMSLRKLWK

SEQ ID NO: 7742 - protein, 423 aa, Oryza sativa
MATADVSRPSSSAPTAAAAGADGHGAKGSAFRGDGLRPYYQSRIHDLQLQIRQGTDNLSRLEAQRNVLNSQVITLGEELKVLHEPGSYVGEVVKVMGKSKVLVKVHPEGKYVVDVDKSIDITKLSPSTRVALRNDSYMLHLILPSKVDPLVNLMKVEKVPDSTYDMIGGLDQQIKEIKEVIELPIKHPELFESLGIAQPKGVLLYGPPGTGKTLLARAVAHHTDCTFIRVSGSELVQKYIGEGSRMVRELFVMAREHAPSIIFMDEIDSIGSARMQSGSGGGDSEVQRTMLELLNQLDGFEASNKIKVLMATNRMDILDQALLRPGRIDRKIEFPNPNEDSRFDILKIHSRKMNLMRGIDLKKIAEKMNGASGAELKAVCTEAGMFALRERRVHVNQEDFLMAVAKVMKKDTEKNMSLRKLWK

SEQ ID NO: 7743 - protein, 418 aa, Glycine max
MALVGVEVKHAAEGAPEENCSAKPTKQGEGLRHYYSHNIHEHQLLLRQKTHNLNRLEAQRNELNSRVRMLREELQLLQEPGSYVGEVVKVMGKNKVLVKVHPEGKYVVDIDKSIDITKITPSTRVALRNDSYVLHLVLPSKVDPLVNLMKVEKVPDSTYDMIGGLDQQIKEIKEVIELPIKHPELFESLGIAQPKGVLLYGPPGTGKTLLARAVAHHTDCTFIRVSGSELVQKYIGEGSRMVRELFVMAREHAPSIIFMDEIDSIGSARMESGSGNGDSEVQRTMLELLNQLDGFEASNKIKVLMATNRIDILDQALLRPGRIDRKIEFPNPNEESRLDILKIHSRRMNLMRGIDLKKIAEKMNGASGAELKAVCTEAGMFALRERRVHVTQEDFEMAVAKVMKKETEKNMSLRKLWK

SEQ ID NO: 7744 - protein, 398 aa, Saccharum officinarum
KGRSGAGGEGLRQYYLQHIHDLQLQIRQKTHNLNRLEAQRNDLNSRVRMLREELQLLQEPGSYVGEVVKVMGKSKVLVKVHPEGKYVVDLDKSIDITKITPSTRVALRNDSYMLHLILPSKVDPLVNLMKVEKVPDSTYDMIGGLDQQIKEIKEVIELPIKHPELFESLGIAQPKGVLLYGPPGTGKTLLARAVAHHTDCTFIRVSGSELVQKYIGEGSRMVRELFVMAREHAPSIIFMDEIDSIGSARMESGTGNGDSEVQRTMLELLNQLDGFEASNKIKVLMATNRIDILDQALLRPGRIDRKIEFPNPNEDSRFDILKIHSRKMNLMRGIDLKKIAEKMNGASGAELKAVCTEAGMFALRERRVHVTQEDFEMAVAKVMKKDTEKNMSLRKLWK

SEQ ID NO: 7745 - protein, 417 aa, Triphysaria pusilla
MATVAIKTRPADQSKQTHQQGAAAVSGEGLRQYYQQRIQDVQLLVRQKVHDLQRLEAQRNDLNARVRSLKEELQLLQEPGSYVGEVVKVMGKSKVLVKVHPEGKYVVDIDKSIDITKITPSTRVALRNDSYVLHLVLPSKVDPLVNLMKVEKVPDSTYDMIGGLDQQIKEIKEVIELPIKHPELFESLGIAQPKGVLLYGPPGTGKTLLARAVAHHTDCTFIRVSGSELVQKYIGEGSRMVRELFVMAREHAPSIIFMDEIDSIGSARMESGSGNGDSEVQRTMLELLNQLDGFEASNKIKVLMATNRIDILDQALLRPGRIDRKIEFPNPNEDSRGDILKIHSRKMNLMRGIDLKKIAEKMGGASGAELKAVCTEAGMFALRERRVHVTQEDFEMAVAKVMKKETEKNMSLRKLWK

SEQ ID NO: 7746 - protein, 419 aa, Brassica napus
MAAVGVESMRPESAMEETCNVKIAAAKQGEGLKQYYLQHIHELQRQLRQKTNNLNRLEAQRNELNSRVRMLREELQLLQEPGSYVGEVVKVMGKNKVLVKVHPEGKYVVDIDKSIDITKITPSTRVALRNDSYVLHLVLPSKVDPLVNLMKVEKVPDSTYDMIGGLDQQIKEIKEVIELPIKHPELFESLGIAQPKGVLLYGPPGTGKTLLARAVAHHTDCTFIRVSGSELVQKYIGEGSRMVRELFVMAREHAPSIIFMDEIDSIGSARMESGSGNGDSEVQRTMLELLNQLDGFEASNKIKVLMATNRIDILDKALLRPGRIDRKIEFPNPNEDSRCDILKIHSRKMNLMRGIDLKKIAEKMNGASGAELKAVCTEAGMFALRERRVHVTQEDFEMAVAKVMKKDTEKNMSLRKLWK

SEQ ID NO: 7747 - protein, 419 aa, Unknown
  Sequence found in Organisms: Brassica napus, Brassica rapa
MAAVGVESMRPETAMEETCNVKIAAAKQGEGLKQYYLQHIHELQRQLRQKTNNLNRLEAQRNELNSRVRMLREELQLLQEPGSYVGEVVKVMGKNKVLVKVHPEGKYVVDIDKSIDINKITPSTRVALRNDSYVLHLVLPSKVDPLVNLMKVEKVPDSTYDMIGGLDQQIKEIKEVIELPIKHPELFESLGIAQPKGVLLYGPPGTGKTLLARAVAHHTDCTFIRVSGSELVQKYIGEGSRMVRELFVMAREHAPSIIFMDEIDSIGSARMESGSGNGDSEVQRTMLELLNQLDGFEASNKIKVLMATNRIDILDQALLRPGRIDRKIEFPNPNEDSRCDILKIHSRKMNLMRGIDLKKIAEKMNGASGAELKAVCTEAGMFALRERRVHVTQEDFEMAVAKVMKKDTEKNMSLRKLWK

SEQ ID NO: 7748 - protein, 420 aa, Cirsium arvense
MAAADIAMKPADSGEKHEICSSKHTTAKQGEGLRQYYLQHIHDAQLQVRQKSHNLNRLEAQRNDLNSRVRMLKEELQLLQEPGSYVGEVVKVMGKSKVLVKVHPEGKYVVDIDKSIDITKITPSTRVALRNDSYVLHLVLPSKVDPLVNLMKVEKVPDSTYDMIGGLDQQIKEIKEVIELPIKHPELFESLGIAQPKGVLLYGPPGTGKTLLARAVAHHTDCTFIRVSGSELVQKYIGEGSRMVRELFVMAREHAPSIIFMDEIDSIGSARMESGSGNGDSEVQRTMLELLNQLDGFEASNKIKVLMATNRIDILDHALLRPGRIDRKIEFPNPNEDSRFDILKIHSRKMNLMRGIDLKKIAEKMNGASGAELKAVCTEGGMFALRERRVHVTQEDFEMAVAKVMKKETEKNMSLRKLWK

SEQ ID NO: 7749 - protein, 419 aa, Rosa hybrid cultivar
MAAVGVETKPVEALPEDTCSAKLAASKLGEGLRPYYLQHIHELQLQVRQKTHNLNRLEAQRNELNSRVRMLREELQLLQEPGSYVGEVVNVMGKNKVLVKVHPEGKYVVDIDKNIDITKITPSTRVALRNDSYVLHLVLPSKVDPLVNLMKVEKVPDSTYDMIGGLDQQIKEIKEVIELPIKHPELFESLGIAQPKGVLLYGPPGTGKTLLARAVAHHTDCTFIRVSGSELVQKYIGEGSRMVRELFVMAREHAPSIIFMDEIDSIGSARMESGSGNGDSEVQRTMLELLNQLDGFEASNKIKVLMATNRIDILDQALLRPGRIDRKIEFPNPNEESRWDILKIHSRRMNLMRGIDLKKIAEKMNGASGAELKAVCTEAGMFALRERRVHVTQEDFEMAVAKVMKKETEKNMSLRKLWK

SEQ ID NO: 7750 - protein, 420 aa, Helianthus annuus
MATADISMKPADSGEKNETCSSIISSAKQGEGLKQYYLQHIHDSQLLVRQKTHNLNRLEAQRNELNSRVRMLKEELQLLQEPGSYVGEVVKVMGKSKVLVKVHPEGKYVVDIDKSIDITKITPSTRVALKNDSYVLHLVLPSKVDPLVNLMKVEKVPDSTYDMIGGLDQQIKEIKEVIELPIKHPELFESLGIAQPKGVLLYGPPGTGKTLLARAVAHHTDCTFIRVSGSELVQKYIGEGSRMVRELFVMAREHAPSIIFMDEIDSIGSARMESGSGNGDSEVQRTMLELLNQLDGFEASNKIKVLMATNRIDILDQALLRPGRIDRKIEFPNPNEDSRFDILKIHSRKMNLMRGIDLKKIAEKMNGASGAELKAVCTEAGMFALRERRVHVTQEDFEMAVAKVMKKETEKNMSLRKLWK

SEQ ID NO: 7751 - protein, 419 aa, Brassica rapa
MAAVGIETRRPEGAMEETCNVKGAVAKQGEGLKQYYLQHIDELQRLLRHKTNNLNRLEAQRNDLNSRVRMLREELQLLQEPGSYVGEVVKVMGKNKVLVKVHPEGKYVVDIDKSIDITKLTPSTRVALRNDSYVLHLVLPSKVDPLVNLMKVEKVPDSTYDMIGGLDQQIKEIKEVIELPIKHPELFESLGIAQPKGVLLYGPPGTGKTLLARAVAHHTDCTFIRVSGSELVQKYIGEGSRMVRELFVMAREHAPSIIFMDEIDSIGSARMESGSGNGDSEVQRTMLELLNQLDGFEASNKIKVLMATNRIDILDQALLRPGRIDRKIEFPNPNEDSRCDILKIHSRKMNLMRGIDLKKIAEQMNGASGAELKAVCTEAGMFALRERRVHVTQEDFEMAVAKVMKKDTEKNMSLRKLWK

SEQ ID NO: 7752 - protein, 420 aa, Raphanus sativus
  misc_feature (11)..(11): Xaa can be any naturally occurring amino acid
  misc_feature (50)..(50): Xaa can be any naturally occurring amino acid
MAAVGIESRRXETAMEAETCNVKGAVAKQGEGLKQYYLQHIDELQRLLRXKTNNLNRLEAQRNDLNSRVRMLREELQLLQEPGSYVGEVVKVMGKNKVLVKVHPEGKYVVDIDKSIDITKLTPSTRVALRNDSYVLHLVLPSKVDPLVNLMKVEKVPDSTYDMIGGLDQQIKEIKEVIELPIKHPELFESLGIAQPKGVLLYGPPGTGKTLLARAVAHHTDCTFIRVSGSELVQKYIGEGSRMVRELFVMAREHAPSIIFMDEIDSIGSARMESGSGNGDSEVQRTMLELLNQLDGFEASNKIKVLMATNRIDILDQALLRPGRIDRKIEFPNPNEDSRFDILKIHSRKMNLMRGIDLKKIAEKMNGASGAELKAVCTEAGMFALRERRVHVTQEDFEMAVAKVMKKDTEKNMSLRKLWK

SEQ ID NO: 7753 - protein, 419 aa, Raphanus sativus
MAAVGVESMRPETAVEETCNIKIGAAKQGEGLKQYYLQHIHELQRQLRQKTNNLNRLEAQRNELNSRVRMLREELQLLQEPGSYVGEVVKVMGKNKVLVKVHPEGKYVVDIDKSIDITKITPSTRVALRNDSYVLHLVLPSKVDPLVNLMKVEKVPDSTYDMIGGLDQQIKEIKEVIELPIKHPELFESLGIAQPKGVLLYGPPGTGKTLLARAVAHHTDCTFIRVSGSELVQKYIGEGSRMVRELFVMAREHAPSIIFMDEIDSIGSARMESGSGNGDSEVQRTMLELLNQLDGFEASNKIKVLMATNRIDILDQALLRPGRIDRKIEFPNPNEDSRFDILKIHSRKMNLMRGIDLKKIAEKMNGASGAELKAVCTEAGMFALRERRVHVTQEDFEMAVGKVMKKDTEKNMSLRKLWK

SEQ ID NO: 7754 - protein, 410 aa, Gossypium hirsutum
RKQPATAEEMCTAKSGAKQGEGLRQYYLQHIHELQLNLRQKTHNLNRLEAQRNELNSRVRMLREELQLLQEPGSYVGEVVKVMGKNKVLVKVHPEGKYVVDIDKSIDITKITPSTRVALRNDSYVLHLILPSKVDPLVNLMKVEKVPDSTYDMIGGLDQQIKEIKEVIELPIKHPELFESLGIAQPKGVLLYGPPGTGKTLLARAVAHHTDCTFIRVSGSELVQKYIGEGSRMVRELFVMAREHAPSIIFMDEIDSIGSARMESGSGNGDSEVQRTMLELLNQLDGFEASNKIKVLMATNRIDILDQALLRPGRIDRKIEFPNPNEESRQDILKIHSRRMNLMRGIDLKKIAEKMNGASGAELKAVCTEAGMFALRERRVHVTQEDFEMAVAKVMKKETEKNMSLRKLWK

SEQ ID NO: 7755 - protein, 417 aa, Papaver somniferum
MATLEVDTYQPETTQKDAVCTSGASLGEGLKRYYEQHIHDLVLLEQSKTNDLNRLEAQRNDFNSKVRMLREELQLLQEPGSYVGEVVKVMGKSKVLVKVHPEGKYVVDIDKSIDITKLTPTTRVALRNDSYVLHLILPSKVDPLVNLMKVEKVPDSTYDMIGGLDQQIKEIKEVIELPIKHPELFESLGIAQPKGVLLYGPPGTGKTLLARAVAHHTDCTFIRVSGSELVQKYIGEGSRMVRELFVMAREHAPSIIFMDEIDSIGSARMESGSGNGDSEVQRTMLELLNQLDGFEASNKIKVLMATNRIDILDPALLRPGRIDRKIEFPNPNEDSRADILRIHSRRMNLMRGIDLKKIAEKMSGASGAELKAVCTEAGMFALRERRVHVTQEDFEMSVAKVMKKETDKNMSLRKLWK

SEQ ID NO: 7756 - protein, 415 aa, Fagus grandifolia
MAIETKHPEAVPADETCSAKASKQGEGLKQYYLQHIHEHQLQVRQKTHNLNRLEAQRNEFNSRVRMLREELQLLQEPGSYVGEVVKVMGKNKVLVKVHPEGKYVVDIDKNIDITKITPSTRVALRNDSYVLHLILPSKVDPLVNLMKVEKVPDSTYDMIGGLDQQIKEIKEVIELPIKHPELFESLGIAQPKGVLLYGPPGTGKTLLARAVAHHTDCTFIRVSGSELVQKYIGEGSRMVRELFVMAREHAPSIIFMDEIDSIGSARMESGSGNGDSEVQRTMLELLNQLDGFEASNKIKVLMATNRIDILDQALLRPGRIDRKIEFPNPNAESRFDILKIHSRRMNLMRGIDLKKIAEKMNGASGAELKAVCTEAGMFALRERRVHVTQEDFEMAVAKVMKKETEKNMSLRKLWK

SEQ ID NO: 7757 - protein, 417 aa, Solanum lycopersicum
MASVDVEKRRSDMEREEACSAKPTKQGEGLRQYYMQHIHDLQLQVRVKTHNLNRLEAQRNELNSKVRMLKEELQLLQEPGSYVGEVVKVMGKSKVLVKVHPEGKYVVDIGKNIDITKITPSTRVALRNDSYVLHLILPSKVDPLVNLMKVEKVPDSTYDMIGGLDQQIKEIKEVIELPIKHPELFESLGIAQPKGVLLYGPPGTGKTLLARAVAHHTDCTFIRVSGSELVQKYIGEGSRMVRELFVMAREHAPSIIFMDEIDSIGSARMESGSGNGDSEVQRTMLELLNQLDGFEASNKIKVLMATNRIDILDQALLRPGRIDRKIEFPNPNEESRQDILKIHSRKMNLMRGIDLKKIAEKMSGASGAELKAVCTEAGMFALRERRVHVTQEDFEMAVAKVMKKETEKNMSLRKLWK

SEQ ID NO: 7758 - protein, 190 aa, Cucurbita pepo
MATMEVETQKVLSTMVDSCSAKQAAKQGEGLRQYYLQHIHELQLQVRQKSHNLNRLEAQRNELNSKVRMLREELQLLQEPGSYVGEVVKVMGKNKVLVKVHPEGKYVVDIDKSIDITKITPSTRVALRNDSYVLHLILPSKVDPLVNLMKVEKVPDSTYDMIGGLDQQIKEIKRLLNFPLSILNYLRVLE

SEQ ID NO: 7759 - protein, 420 aa, Centaurea maculosa
  misc_feature (415)..(415): Xaa can be any naturally occurring amino acid
MASVEVAMNLSDSGDRDESCSSRPTTAKTGDGLRQYYLQHIHDAQLQVRQKTHNLNRLEAQRNELNSRVRMLKEELQLLQEPGSYVGEVVKVMGKSKVLVKVHPEGKYVVDIDKSIDITKITPSTRVALRNDSYVLHLVLPSKVDPLVNLMKVEKVPDSTYDMIGGLDQQIKEIKEVIELPIKHPELFESLGIAQPKGVLLYGPPGTGKTLLARAVAHHTDCTFIRVSGSELVQKYIGEGSRMVRELFVMAREHAPSIIFMDEIDSIGSARMESGSGNGDSEVQRTMLELLNQLDGFEASNKIKVLMATNRIDILDQALLRPGRIDRKIEFPNPNEDSRFDILKIHSRKMNLMRGIDLKKIAEKMNGASGAELKAVCTEAGMFALRERRVHVTQEDFEMAVAKVMKKETEKNMSXRKLWK

SEQ ID NO: 7760 - protein, 178 aa, Tragopogon dubius
MVRELFVMAREHAPSIIFMDEIDSIGSARMESGSGNGDSEVQRTMLELLNQLDGFEASNKIKVLMATNRIDILDQALLRPGRIDRKIEFPNPNEDSRFDILKIHSRRMNLMRGIDLKKIAEKMNGASGAELKAVCTEAGMFALRERRVHVTQEDFEMAVAKVMKKETEKNMSLRKLWK

SEQ ID NO: 7761 - protein, 364 aa, Helianthus annuus
MATADISMKPADSREKNETCSSIISSAKQGEGLKQYYLQHIHDSQLLVRQKTHNLNRLEAQRNELNSRVRMLKEELQLLQEPGSYVGEVVKVMGKSKVLVKVHPEGKYVVDIDKSIDITKITPSTRVALKNDSYVLHLVLPSKVDPLVNLMKVEKVPDSTYDMIGGLDQQIKEIKEVIELPIKHPELFESLGIAQPKGVLLYGPPGTGKTLLARAVAHHTDCTFIRVSGSELVQKYIGEGSRMVRELFVMAREHAPSIIFMDEIDSIGSARMESGSGNGDSEVQRTMLELLNQLDGFEASNKIKVLMATNRIDILDQALLRPGRIDRKIEFPNPNEDSRFDILKIHSRKMNLMRGIDLKKLLRR

SEQ ID NO: 7762 - protein, 426 aa, Aquilegia formosa
MATVAVDTAKAVEIGTTEMMMCNNNNNTSAGKTKQGEGLRQYYLQHIHDLQLLLRQKTHNLNRLEAQRNELNARVRMLREELQLLQEPGSYVGEVVKVMGKSKVLVKVHPEGKYVVDIDKSIDITKITPSTRVALRNDSYVLHLILPSKVDPLVNLMKVEKVPDSTYDMIGGLDQQIKEIKEVIELPIKHPELFESLGIAQPKGVLLYGPPGTGKTLLARAVAHHTDCTFIRVSGSELVQKYIGEGSRMVRELFVMAREHAPSIIFMDEIDSIGSARMESGTGNGDSEVQRTMLELLNQLDGFEASNKIKVLMATNRIDILDQALLRPGRIDRKIEFPNPNEESRFDILKIHSRRMNLMRGIDLKKIAEKMNGASGAELKAVCTEAGMFALRERRVHVTQEDFEMAVAKVMKKESEKNMSLRKLWK

SEQ ID NO: 7763 - protein, 419 aa, Eutrema halophilum
MAAVGVDSRRLETTMEETCNVKGAVAKQGEGLKQYYLQHIHELQRQLRQKTNNLNRLEAQRNELNSRVRMLREELQLLQEPGSYVGEVVKVMGKNKVLVKVHPEGKYVVDIDKSIDITKITPSTRVALRNDSYVLHLVLPSKVDPLVNLMKVEKVPDSTYDMIGGLDQQIKEIKEVIELPIKHPELFESLGIAQPKGVLLYGPPGTGKTLLARAVAHHTDCTFIRVSGSELVQKYIGEGSRMVRELFVMAREHAPSIIFMDEIDSIGSARMESGSGNGDSEVQRTMLELLNQLDGFEASNKIKVLMATNRIDILDQALLRPGRIDRKIEFPNPNEDSRFDILKIHSRKMNLMRGIDLKKIGEKMNGASGAELKAVCTEAGMFALRERRVHVTQEDFEMAVAKVMKKDTEKNMSLRKLWK

SEQ ID NO: 7764 - protein, 419 aa, Brassica rapa
MAAVGVESMRPETAMEETCNVKIAAAKQGEGLKQYYLQHIHELQRQLRQKTNNLNRLEAQRNELNSRVRMLREELQLLQEPGSYVGEVVKVMGKNKVLVKVHPEGKYVVDIDKSIDINKITPSTRVALRNDSYVLHLVLPSKVDPLVNLMKVEKVPDSTYDMIGGLDQQIKEIKEVIELPIKHPELFESLGIAQPKGVLLYGPPGTGKTLLARAVAHHTDCTFLRVSGSELVQKYIGEGSRMVRELFVMAREHAPSIIFMDEIDSIGSARMESGSGNGDSEVQRTMLELLNQLDGFEASNKIKVLMATNRIDILDQALLRPGRIDRKIEFPNPNEDSRCDILKIHSRKMNLMRGIDLKKIAEKMNGASGAELKAVCTEAGMFALRERRVHVTQEDFEMAVAKVMKKDTEKNMSLRKLWK

SEQ ID NO: 7765 - protein, 419 aa, Fragaria vesca
MAAVAAETKPIDAVPEETCSSKLAASKLGDGLRPYYLQHIHELQLQVRQKTHNLNRLEAQRNELNSRVRMLREELQLLQEPGSYVGEVVNVMGKNKVLVKVHPEGKYVVDIDKNIDITKITPSTRVALRNDSYVLHLVLPSKVDPLVNLMKVEKVPDSTYDMIGGLDQQIKEIKEVIELPIKHPELFESLGIAQPKGVLLYGPPGTGKTLLARAVAHHTDCTFIRVSGSELVQKYIGEGSRMVRELFVMAREHAPSIIFMDEIDSIGSARMESGSGNGDSEVQRTMLELLNQLDGFEASNKIKVLMATNRIDILDQALLRPGRIDRKIEFPNPNEESRWDILKIHSRRMNLMRGIDLKKIAEKMNGASGAELKAVCTEAGMFALRERRVHVTQEDFEMAVAKVMKKETEKNMSLRKLWK

SEQ ID NO: 7766 - protein, 342 aa, Cichorium intybus
MATAEVAMKPADSGERDESCSSRPTAAKAGEGLRQYYLQHIHDAQLQVRQKTHNLNRLEAQRNELNSRVRMLKEELQLLQEPGSYVGEVVKVMGKSKVLVKVHPEGKYVVDIDKSIDITKITPSTRVALRNDSYVLHLVLPSKVDPLVNLMKVEKVPDSTYDMIGGLDQQIKEIKEVIELPIKHPELFESLGIAQPKGVLLYGPPGTGKTLLARAVAHHTDCTFIRVSGSELVQKYIGEGSRMVRELFVMAREHAPSIIFMDEIDSIGSARMESGSGNGDSEVQRTMLELLNQLDGFEASNKIKVLMATNRIDILDQALLRPGRIDRKIEFQILMKIHDVIF

SEQ ID NO: 7767 - protein, 404 aa, Eschscholzia californica
MATAVVEKTMVKQGEGLRQYYSQHIHDLQLQVRQKTHNLNRLEAQRNDLNSRVRMLREELQLLQEPGSYVGEVVKVMGKSKVLVKVHPEGKYVVDIDKSIDITKITPSTRVALRNDSYVLHLILPSKVDPLVNLMKVEKVPDSTYDMIGGLDQQIKEIKEVIELPIKHPELFESLGIAQPKGVLLYGPPGTGKTLLARAVAHHTDCTFIRVSGSELVQKYIGEGSRMVRELFVMAREHAPSIIFMDEIDSIGSARMESGTGNGDSEVQRTMLELLNQLDGFEASNKIKVLMATNRIDILDQALLRPGRIDRKIEFPNPNAESRWDILKIHSRRMNLMRGIDLKKIAEKMNGASGAELKAVCTEAGMFALRERRVHVTQEDFEMAVGKVMKKETEKNMSLRKLWK

SEQ ID NO: 7768 - protein, 426 aa, Populus trichocarpa
MATVGVERKQQQQTESTMTMIAEESCSAKTGAVRQGEGLKQYYLQHIHELQLLVRQKSHNLNRLEAQRNGLNSRVRMLREESQLLQEPGSYVGEVVKVMGKNKVLVKVHPEGKYVVDIDKSIDITKITPSTRVALRNDSYVLHLILPSKVDPLVNLMKVEKVPDSTYDMIGGLDQQIKEIKEVIELPIKHPELFESLGIAQPKGVLLYGPPGTGKTLLARAVAHHTDCTFIRVSGSELVQKYIGEGSRMVRELFVMAREHAPSIIFMDEIDSIGSARMESGSGNGDSEVQRTMLELLNQLDGFEASNKIKVLMATNRIDILDQALLRPGRIDRKIEFPNPNVDSRFDIVKIHSRRMNLMRGIDMKKIAEKMNGASGAELKAVCTEAGMFALRERRVHVTQEDFEMAVAKVMKKETEKNMSLRKLWK

SEQ ID NO: 7769 - protein, 418 aa, Glycine max
MALVGVELKHAAEGVPEANCSAKPTKQGEGLRHYYSLNIHEHQLLLRQKTHNLNRLEAQRNDLNSRVRMLREELQLLQEPGSYVGEVVKVMGKNKVLVKVHPEGKYVVDIDKNIDITKITPSTRVALRNDSYVLHLVLPSKVDPLVNLMKVEKVPDSTYDMIGGLDQQIKEIKEVIELPIKHPELFESLGIAQPKGVLLYGPPGTGKTLLARAVAHHTDCTFIRVSGSELVQKYIGEGSRMVRELFVMAREHAPSIIFMDEIDSIGSARMESGSGNGDSEVQRTMLELLNQLDGFEASNKIKVLMATNRIDILDQALLRPGRIDRKIEFPNPNEESRLDILKIHSRRMNLMRGIDLKKIAEKMNGASGAELKAVCTEAGMFALRERRVHVTQEDFEMAVAKVMKKETEKNMSLRKLWK

SEQ ID NO: 7770 - protein, 420 aa, Flaveria ramosissima
MATAEIAMNPSDSGEKDDSYLSRHMGSKPGEGLKQYYQQHIHDAQLQVRQKTHNLNRLEAQRNELNSRVRMLKEELQMLQEPGSYVGEVVKVMGKSKVLVKVHPEGKYVVDIDKSIDITKITPSTRVALKNDSYVLHLVLPSKVDPLVNLMKVEKVPDSTYDMIGGLDQQIKEIKEVIELPIKHPELFESLGIAQPKGVLLYGPPGTGKTLLARAVAHHTDCTFIRVSGSELVQKYIGEGSRMVRELFVMAREHAPSIIFMDEIDSIGSARMESGSGNGDSEVQRTMLELLNQLDGFEASNKIKVLMATNRIDILDQALLRPGRIDRKIEFPNPNEDSRFDILKIHSRKMNLMRGIDLKKIAEKMNGASGAELKAVCTEAGMFALRERRVHVTQEDFEMAVAKVMKKETEKNMSLRKLWK

SEQ ID NO: 7771 - protein, 350 aa, Vinca minor
MLKEELQLLQEPGSYVGEVVKVMGKSKVLVKVHPEGKYVVDIDKNIDITKLSPSTRVALKNDSYMLHLILPSKVDPLVNLMKVEKVPDSTYDMIGGLDQQIKEIKEVIELPIKHPELFESLGIAQPKGVLLYGPPGTGKTLLARAVAHHTDCTFIRVSGSELVQKYIGEGSRMVRELFVMAREHAPSIIFMDEIDSIGSARMESGSGNGDSEVQRTMLELLNQLDGFEASNKIKVLMATNRIDILDHALLRPGRIDRKIEFPNPNEESRFDILKIHSRRMNLMRGIDLKKIAEKMNGASGAELKAVCTEAGMFALRERRVHVTQEDFEMAVGKVMKKDSEKNMSLRKLWK

SEQ ID NO: 7772 - protein, 409 aa, Ambrosia trifida
MVSAEISTKGLKQMDSKPGEGLKQYYQQHIHDAQLQVRHKTNNLNRLQAQRNDLNSKVRMLKEELQLLQEPGSYVGEVVKVMGKSKVLVKVHPEGKYVVDIDKSIDITKITPSTRVALKNDSYVLHLVLPSKVDPLVNLMKVEKVPDSTYDMIGGLDQQIKEIKEVIELPIKHPELFESLGIAQPKGVLLYGPPGTGKTLLARAVAHHTDCTFIRVSGSELVQKYIGEGSRMVRELFVMAREHAPSIIFMDEIDSIGSARMESGSGNGDSEVQRTMLELLNQLDGFEASNKIKVLMATNRIDILDQALLRPGRIDRKIEFPNPNEDSRFDILKIHSRKMNLMRGIDLKKIAEKMNGASGAELKAVCTEAGMFALRERRVHVTQEDFEMAVAKVMKKDTEKNMSLRKLWK

SEQ ID NO: 7773 - protein, 408 aa, Distylium racemosum
EKKQQQQYHLNNKMVKQGEGLRQYYLQHIHDLQLQVRQKTHNLNRLEAQRNDLNSKVRMLREELQLLQEPGSYVGEVVKVMGKSKVLVKVHPEGKYVVDIDKNIDITKITPSTRVALRNDSYVLHLILPSKVDPLVNLMKVEKVPDSTYDMIGGLDQQIKEIKEVIELPIKHPELFESLGIAQPKGVLLYGPPGTGKTLLARAVAHHTDCTFIRVSGSELVQKYIGEGSRMVRELFVMAREHAPSIIFMDEIDSIGSARMESGTGNGDSEVQRTMLELLNQLDGFEASNKIKVLMATNRIDILDQALLRPGRIDRKIEFPNPNEESRWDILKIHSRKMNLMRGIDLKKIAEKMNGASGAELKAVCTEAGMFALRERRVHVTQEDFEMAVAKVMKKETEKNMSLRKLWK

SEQ ID NO: 7774 - protein, 402 aa, Valeriana officinalis
MEIEKPAMIKQGEGLRQYYHQHIHDLQLQVRQKTHNLNRLEAQRNDLNSKVRMLKEELQLLQEPGSYVGEVVKVMGKSKVLVKVHPEGKYVVDIDKSIDITKITPSTRVALRNDSYVLHLVLPSKVDPLVNLMKVEKVPDSTYDMIGGLDQQIKEIKEVIELPIKHPELFESLGIAQPKGVLLYGPPGTGKTLLARAVAHHTDCTFIRVSGSELVQKYIGEGSRMVRELFVMAREHAPSIIFMDEIDSIGSARMESGSGNGDSEVQRTMLELLNQLDGFEASNKIKVLMATNRIDILDQALLRPGRIDRKIEFPNPNEESRWDILKIHSRRMNLMRGIDLKKIAEKMHGASGAELKAVCTEAGMFALRERRVHVTQEDFEMAVAKVMKKETEKNMSLRKLWK

SEQ ID NO: 7775 - protein, 426 aa, Aquilegia formosa
MATVAVDTAKAVEIGTTEMMMCNNNNNTSAGKTKQGEGLRQYYLQHIHDLQLLLRQKTHNLNRLEAQRNELNARVRMLREELQLLQEPGSYVGEVVKVMGKSKVLVKVHPEGKYVVDIDKSIDITKITPSTRVALRNDSYVLHLVLPSKVDPLVNLMKVEKVPDSTYDMIGGLDQQIKEIKEVIELPIKHPELFESLGIAQPKGVLLYGPPGTGKTLLARAVAHHTDCTFIRVSGSELVQKYIGEGSRMVRELFVMAREHAPSIIFMDEIDSIGSARMESGTGNGDSEVQRTMLELLNQLDGFEASNKIKVLMATNRIDILDQALLRPGRIDRKIEFPNPNEESRFDILKIHSRRMNLMRGIDLKKIAEKMNGASGAELKAVCTEAGMFALRERRVHVTQEDFEMAVAKVMKKESEKNMSLRKLWK

SEQ ID NO: 7776 - protein, 417 aa, Phaseolus coccineus
MALAGVEVKHVEAVPEENCSAKPTKQGEGLRHYYSLNIHEHQLLLRQKTHNLNRLEAQRNELNSRVRMLREELQLLQEPGSYVGEVVKVMGKNKVLVKVHPEGKYVVDIDKSIDITKITPSTRVALRNDSYVLHLVLPSKVDPLVNLMKVEKVPDSTYDMIGGLDQQIKEIKEVIELPIKHPELFESLGIAQPKGVLLYGPPGTGKTLLARAVAHHTDCTFIRVSGSELVQKYIGEGSRMVRELFVMAREHAPSIIFMDEIDSIGSARMESGSGNGDSEVQRTMLELLNQLDGFEASNKIKVLMATNRIDILDQALLRPGRIDRKIEFPNPNEESRLDILKIHSRRMNLMRGIDLKKIAEKMNGASGAELKAVCTEAGMFALRERRVHVTQEDFEMAVAKVMKKETEKNMSLRKLWK

SEQ ID NO: 7777 - protein, 396 aa, Festuca arundinacea
DEASCGEGLRQYYLQHIHDLQLQIRQKTHNLNRLEAQRNDLNSRVRMLREELQLLQEPGSYVGEVVKVMGKSKVLVKVHPEGKYVVDLDKSIDINKITPSTRVALRNDSYMLHLILPSKVDPLVNLMKVEKVPDSTYDMIGGLDQQIKEIKEVIELPIKHPELFESLGIAQPKGVLLYGPPGTGKTLLARAVAHHTDCTFIRVSGSELVQKYIGEGSRMVRELFVMAREHAPSIIFMDEIDSIGSARMESGTGNGDSEVQRTMLELLNQLDGFEASNKIKVLMATNRIDILDQALLRPGRIDRKIEFPNPNADSRGDILKIHSRKMNLMRGIDLKKIAEKMNGASGAELKAVCTEAGMFALRERRVHVTQEDFEMAVAKVMKKDTEKNMSLRKLWK

SEQ ID NO: 7778 - protein, 412 aa, Arachis hypogaea
MKHAAEAAPEENCSAKPAVKQGEGLRQYYSLHIHELQLLLRQKTHNLNRLEAQRNELNSRVRMLREELQLLQEPGSYVGEVVKVMGKNKVLVKVHPEGKYVVDIDKNIDITKITPSTRVALRNDSYVLHLVLPSKVDPLVNLMKVEKVPDSTYDMIGGLDQQIKEIKEVIELPIKHPELFESLGIAQPKGVLLYGPPGTGKTLLARAVAHHTDCTFIRVSGSELVQKYIGEGSRMVRELFVMAREHAPSIIFMDEIDSIGSARMESGSGNGDSEVQRTMLELLNQLDGFEASNKIKVLMATNRIDILDQALLRPGRIDRKIEFPNPNEESRLDILKIHSRRMNLMRGIDLKKIAEKMNGASGAELKAVCTEAGMFALRERRVHVTQEDFEMAVAKVMKKETEKNMSLRKLWK

SEQ ID NO: 7779 - protein, 299 aa, Plantago ovata
MATAAIDNRQSDDSKQQQLHQLGGAGDGEGLRQYYQQRIQDQQLLLRQRVYDLQRLEAQRNDLNGRVRSLKEELQLLQEPGSYVGEVVKVMGKSKVLVKVHPEGKYVVDIDKSIDITKITPSMRVALRNDSYVLHLILPSKVDPLVNLMKVEKVPDSTYDMIGGLDQQIKEIKEVIELPIKHPELFESLGIAQPKGVLLYGPPGTGKTLLARAVAHHTDCTFIRVSGSELVQKYIGEGSRMVRELFVMAREHAPSIIFMDEIDSIGSARMESGSGNGDSEVQRTMLDLLNQLDGFEASK

SEQ ID NO: 7780 - protein, 411 aa, Cephalotaxus harringtonia
METLKGKQQEQIKSKKMVKQGEGLRQYYMQHIHDLQLQVRQKTHNLNRLEAQRNDLNSKVRALREELQLLQEPGSYVGEVVKVMGKSKVLVKVHPEGKYVVDIDKNIDITKITPSTRVALRNDSYVLHLILPSKVDPLVNLMKVEKVPDSTYDMIGGLDQQIKEIKEVIELPIKHPELFESLGIAQPKGVLLYGPPGTGKTLLARAVAHHTDCTFIRVSGSELVQKYIGEGSRMVRELFVMAREHAPSIIFMDEIDSIGSARMESGSGNGDSEVQRTMLELLNQLDGFEASNKIKVLMATNRIDILDQALLRPGRIDRKIEFPNPNEESRWDILKIHSRKMNLMRGIDLKKIAEKMNGASGAELKAVCTEAGMFALRERRVHVTQEDFEMAVAKVMKKETEKNMSLRKLWK

SEQ ID NO: 7781 - protein, 429 aa, Vinca minor
MAAATIIESSNWSSSEEAATGNGGALKHYHQQQKQGGRGEGLRQYYLLRIHDLLLQVRHKSDDLLRLEAQRNELNSRVRMLKEELQLLQEPGSYVGEVVKVMGKSKVLVKVHPEGKYVVDIDKNIDITKLSPSTRVALKNDSYMLHLILPSKVDPLVNLMKVEKVPDSTYDMIGGLDQQIKEIKEVIELPIKHPELFESLGIAQPKGVLLYGPPGTGKTLLARAVAHHTDCTFIRVSGSELVQKYIGEGSRMVRELFVMAREHAPSIIFMDEIDSIGSARMESGSGNGDSEVQRTMLELLNQLDGFEASNKIKVLMATNRIDILDQALLRPGRIDRKIEFPNPNEESRFDILKIHSRRMNLMRGIDLKKIAEKMNGASGAELKAVCTEAGMFALRERRVHVTQEDFEMAVGKVMKKDSEKNMSLRKLWK

SEQ ID NO: 7782 - protein, 421 aa, Solanum lycopersicum
MASADVEKSRIDMEREEACSAKPTKQGEGLRQYYMQHIHDLQLQVRVKTHNLNRLEAQRNELNSKVRMLKEELQLLQEPGSYVGEVVKVMGKSKVLVKVHPEGKYVVDIGKNIDITKITPSTRVALRNDSYVLHLILPSKVDPLVNLMKVEKVPDSTYDMIGGLDQQIKEIKEVIELPIKHPELFESLGIAQPKGVLLYGPPGTGKTLLARAVAHHTDCTFIRVSGSELVQKYIGEGSRMVRELFVMAREHAPSIIFMDEIDSIGSARMESGSGNGDSEVQRTMLELLNQLDGFEASNKIKASSTVLMATNRIDILDQALLRPGRIDRKIEFPNPNEESRQDILKIHSRKMNLMRGIDLKKIAEKMSGASGAELKAVCTEAGMFALRERRVHVTQEDFEMAVAKVMKKETEKNMSLRKLWK

SEQ ID NO: 7783 - protein, 395 aa, Amborella trichopoda
MVKQGEGLRQYYLQHIHDLQLQVRQKTHNLNRLEAQRNDLNSRVRMLREELQLLQEPGSYVGEVVKVMGKSKVLVKVHPEGKYVVDIDKNIDITKITPSTRVALRNDSYVLHLILPSKVDPLVNLMKVEKVPDSTYDMIGGLDQQIKEIKEVIELPIKHPELFESLGIAQPKGVLLYGPPGTGKTLLARAVAHHTDCTFIRVSGSELVQKYIGEGSRMVRELFVMAREHAPSIIFMDEIDSIGSARMESGTGNGDSEVQRTMLELLNQLDGFEASNKIKVLMATNRIDILDQALLRPGRIDRKIEFPNPNEESRLDILKIHSRKMNLMRGIDLKKIAEKMNGASGAELKAVCTEAGMFALRERRVHVTQEDFEMAVAKVMKKETEKNMSLRKLWK

SEQ ID NO: 7784 - protein, 395 aa, Amborella trichopoda
MVKQGEGLRQYYVQHIHDLQLQVRQKTHNLNRLEAQRNDLNSKVRMLREELQLLQEPGSYVGEVVKVMGKSKVLVKVHPEGKYVVDIDKNIDITKITPSTRVALRNDSYVLHLILPSKVDPLVNLMKVEKVPDSTYDMIGGLDQQIKEIKEVIELPIKHPELFESLGIAQPKGVLLYGPPGTGKTLLARAVAHHTDCTFIRVSGSELVQKYIGEGSRMVRELFVMAREHAPSIIFMDEIDSIGSARMESGTGNGDSEVQRTMLELLNQLDGFEASNKIKVLMATNRIDILDQALLRPGRIDRKIEFPNPNEESRLDILKIHSRKMNLMRGIDLKKIAEKMNGASGAELKAVCTEAGMFALRERRVHVTQEDFEMAVAKVMKKETEKNMSLRKLWK

SEQ ID NO: 7785 - protein, 395 aa, Cephalotaxus harringtonia
MVKQGEGLRQYYLQHIHDLQLQVRQKTHNLNRLEAQRNDLNSKVRMLREELQLLQEPGSYVGEVVKVMGKSKVLVKVHPEGKYVVDIDKNIDITKITPSTRVALRNDSYMLHLILPSKVDPLVNLMKVEKVPDSTYDMIGGLDQQIKEIKEVIELPIKHPELFESLGIAQPKGVLLYGPPGTGKTLLARAVAHHTDCTFIRVSGSELVQKYIGEGSRMVRELFVMAREHAPSIIFMDEIDSIGSTRMESGSGNGDSEVQRTMLELLNQLDGFEASNKIKVLMATNRIDILDHALLRPGRIDRKIEFPNPNEESRWDILKIHSRKMNLMRGIDLKKIAGKMNGASGAELKAVCTEAGMFALRERRVHVTQEDFEMAVAKVMKKETEKNMSLRKLWK

SEQ ID NO: 7786 - protein, 394 aa, Elaeis guineensis
GGGGEGLRQYYLQHIHDLQLQLRQKTHNLNRLEAQRNELNSRVRMLREELQLLQEPGSYVGEVVKVMGKSKVLVKVHPEGKYVVDIDKNIDITKITPSTRVALRNDSYVLHLILPSKVDPLVNLMKVEKVPDSTYDMIGGLDQQIKEIKEVIELPIKHPELFESLGIAQPKGVLLYGPPGTGKTLLARAVAHHTDCTFIRVSGSELVQKYIGEGSRMVRELFVMAREHAPSIIFMDEIDSIGSARMESGTGNGDSEVQRTMLELLNQLDGFEASNKIKVLMATNRIDILDQALLRPGRIDRKIEFPNPNEESRLDILKIHSRKMNLMRGIDLKKIAEKMNGASGAELKAVCTEAGMFALRERRVHVTQEDFEMAVAKVMKKETEKNMSLRKLWK

SEQ ID NO: 7787 - protein, 625 aa, Brachypodium distachyon
MAAVEMAISKPSTLPGVDDPASSAAKGRAGGGEGLRQYYQQHIHDLQLQIRQKTHNLNRLEAQRNDLNSRVRMLREELQLLQEPGSYVGEVVKVMGKSKVLVKVHPEGKYVVDLDKSIDITKITPSTRVALRNDSYMLHLILPSKVDPLVNLMKVEKVPDSTYDMIGGLDQQIKEIKEVIELPIKHPELFESLGIAQPKGVLLYGPPGTGKTLLARAVAHHTDCTFIRVSGSELVQKYIGEGSRMVRELFVMAREHAPSIIFMDEIDSIGSARMESGTGNGDSEVQRTMLELLNQLDGFEASNKIKVLMATNRIDILDQALLRPGRIDRKIEFPNPNADSRGDILKIHSRKMNLMRGIDLKKIAEKMNGASGAELKAVCTEAGMFALRERRVHVTQEDFEMAVAKALPNTPPVDYPCFKLVLVGDGGTGKTTFVKRHITGEFEKKYEPTIGVEVRPLDFHTSHGKIRFYCWDTAGQEKFGGLRDGYYIHGQCAIIMFDVTSRLTYKNVPTWHRDICRVCENIPIVLCGNKVDMKNRQVKAKMVTFHRKKSLQYYEISAKSNYNFEKPFLYLARKLSGDMNLRFVEETALLPADVTVDLITQQQIEAEIAAAAAMPLPDDDEDNMD

SEQ ID NO: 7788 - protein, 433 aa, Unknown
  Sequence found in Organisms: Pinus pinaster, Pinus taeda
MRVEELGGILKPASDLEAAANAKEKLKEKHQLPKESNRMVKHGEGLRQYYLQHIHDLQLQVRQKTHNLNRLEAQRNDLNSKVRALREELQLLQEPGSYVGEVVKVMGKSKVLVKVHPEGKYVVDVDKNIDITKITPSTRVALRNDSYVLHLILPSKVDPLVNLMKVEKVPDSTYDMIGGLDQQIKEIKEVIELPIKHPELFESLGIAQPKGVLLYGPPGTGKTLLARAVAHHTDCTFIRVSGSELVQKYIGEGSRMVRELFVMAREHAPSIIFMDEIDSIGSARMESGTGNGDSEVQRTMLELLNQLDGFEASNKIKVLMATNRIDILDQALLRPGRIDRKIEFPNPNEESRFDILKIHSRKMNLMRGIDLKKIAEKMSGASGAELKAVCTEAGMFALRERRVHVTQEDFEMAVAKVMKKETEKNMSLRKLWK

SEQ ID NO: 7789 - protein, 420 aa, Zostera marina
MAAMEVETNLVAKKVITSMEMRSPGKVRAGDGLRGYYMQHINDLMLQVNQKSDNLGRLKAQRNDLNSKVRMLKEELQLLQEPGSYVGEVVKVMGKSKVLVKVHPEGKYVVDIDKSIDITKITPSTRVALRNDSYVLHLVLPSKVDPLVNLMKVEKVPDSTYDMIGGLDQQIKEIKEVIELPIKHPELFESLGIAQPKGVLLYGPPGTGKTLLARAVAHHTDCTFIRVSGSELVQKYIGEGSRMVRELFVMAREHAPSIIFMDEIDSIGSARMESGSGNGDSEVQRTMLELLNQLDGFEASNKIKVLMATNRIDILDQALLRPGRIDRKIEFPNPNGESRCDILKIHSRKMNLMRGIDLKKIAEKLNGASGAELKAVCTESGMFALRERRVHVTQEDFEMAVAKVMKKETEKNMSLRKLWK

SEQ ID NO: 7790 - protein, 331 aa, Ambrosia trifida
MVSAEISTKALKQMDSKPGDGLKQYYQQHIHDAQLQVRHKTNNLNRLQAQRNDLNSKVRMLKEELQLLQEPGSYVGEVVKVMGKSKVLVKVHPEGKYVVDIDKSIDITKITPSTRVALKNDSYVLHLVLPSKVDPLVNLMKVEKVPDSTYDMIGGLDQQIKEIKEVIELPIKHPELFESLGIAQPKGVLLYGPPGTGKTLLARAVAHHTDCTFIRVSGSELVQKYIGEGSRMVRELFVMAREHAPSIIFMDEIDSIGSARMESGSGNGDSEVQRTMLELLNQLDGFEASNKIKVLMATNRIDILDQALLRPGRIDRKLNFQIPMKTRGLIS

SEQ ID NO: 7791 - protein, 417 aa, Vigna unguiculata
MALAGVEVKHVEVVPEENCSAKPTKQGEGLRHYYSLNIHEHQLLLRQKTHNLNRLEAQRNELNSRVRMLREELQLLQEPGSYVGEVVKVMGKNKVLVKVHPEGKYVVDIDKNIDITKITPSTRVALRNDSYVLHLVLPSKVDPLVNLMKVEKVPDSTYDMIGGLDQQIKEIKEVIELPIKHPELFESLGIAQPKGVLLYGPPGTGKTLLARAVAHHTDCTFIRVSGSELVQKYIGEGSRMVRELFVMAREHAPSIIFMDEIDSIGSARMESGSGNGDSEVQRTMLELLNQLDGFEASNKIKVLMATNRIDILDQALLRPGRIDRKIEFPNPNEESRLDILKIHSRRMNLMRGIDLKKIAEKMNGASGAELKAVCTEAGMFALRERRVHVTQEDFEMAVAKVMKKETEKNMSLRKLWK

SEQ ID NO: 7792 - protein, 396 aa, Gnetum gnemon
MMVKQGEGLRHYYLQNIHDLQLQVRQKTHNLNRLEALRNDLNSKVRMLREELQLLQEPGSYVGEVVKVMGKSKVLVKVHPEGKYVVDVDKNIDITKITPSARVALRNDSYVLHLILPSKVDPLVNLMKVEKVPDSTYDMIGGLDQQIKEIKEVIELPIKHPELFESLGIAQPKGVLLYGPPGTGKTLLARAVAHHTDCTFIRVSGSELVQKYIGEGSRMVRELFVMAREHAPSIIFMDEIDSIGSARMESGSGNGDSEVQRTMLELLNQLDGFEASNKIKVLMATNRIDILDQALLRPGRIDRKIEFPNPNEESRFDILKIHSRKMNLMRGIDLRKIAEKMNGASGAELKAVCTEAGMFALRERRVHVTQEDFEMAVAKVMKKETEKNMSLRKLWK

SEQ ID NO: 7793 - protein, 410 aa, Marchantia polymorpha
EYQAEEAPYRRAGGAGVGGGDGLRNYYLGHTHDLLLQLRVKTHNLHRLEAQRNDLNSKVRMLREELQLLQEPGSYVGEVVKVVGKTKVLVKVHPEGKYVVDIDKNIDINKITPSTRVALRNDSYVLHLILPSKVDPLVNLMKVEKVPDSTYDMIGGLDQQIKEIKEVIELPIKHPELFESLGIAQPKGVLLYGPPGTGKTLLARAVAHHTDCTFIRVSGSELVQKYIGEGSRMVRELFVMAREHAPSIIFMDEIDSIGSARMESGNGNGDSEVQRTMLELLNQLDGFEASNKIKVLMATNRIDILDQALLRPGRIDRKIEFPNPSEESRLDILKIHSRRMNLMRGIDLKKIAEKMGGASGAELKSVCTEAGMFALRERRVHVTQEDFEMAVAKVMKKETEKNMSLKKLWK

SEQ ID NO: 7794 - protein, 395 aa, Taxus baccata
MVKQGEGLRQYYLQHIHDLQLQVRQKTHNLNRLEAQRNDLNSKVRMLREELQLLQEPGSYVGEVVKVMGKSKVLVKVHPEGKYVVDIDKNIDITKITPSTRVALRNDSYTLHLILPSKVDPLVNLMKVEKVPDSTYDMIGGLDQQIKEIKEVIELPIKHPELFESLGIAQPKGVLLYGPPGTGKTLLARAVAHHTDCTFIRVSGSELVQKYIGEGSRMVRELFVMAREHAPSIIFMDEIDSIGSTRMESGSGNGDSEVQRTMLELLNQLDGFEASNKIKVLMATNRIDILDQALLRPGRIDRKIEFPNPNEESRWDILKIHSRKMNLMRGIDLKKIAEKMNGASGAELKAVCTEAGMFALRERRVHVTQEDFEMAVAKVMKKETDKNMSLRKLWK

SEQ ID NO: 7795 - protein, 286 aa, Ambrosia trifida
MLKEELQLLQEPGSYVGEVVKVMGKSKVLVKVHPEGKYVVDIDKSIDITKITPSTRVALKNDSYVLHLVLPSKVDPLVNLMKVEKVPDSTYDMIGGLDQQIKEIKEVIELPIKHPELFESLGIAQPKGVLLYGPPGTGKTLLARAVAHHTDCTFIRVSGSELVQKYIGEGSRMVRELFVMAREHAPSIIFMDEIDSIGSARMESGSGNGDSEVQRTMLELLNQLDGFEASNKIKVLMATNRIDILDQALLRPGRIDRKIEFPNPNEDSRFDILKIHSRKMKLNAWH

SEQ ID NO: 7796 - protein, 423 aa, Cedrus atlantica
DKTSDLEAAANTKEKLKEKHQLPKESNKMVKQGEGLRQYYLQHIHDLQLQVRQKTHNLNRLEAQRNDLNSKVRALREELQLLQEPGSYVGEVVKVMGKSKVLVKVHPEGKYVVDVDKNIDITKITPSTRVALRNDSYVLHLILPSKVDPLVNLMKVEKVPDSTYDMIGGLDQQIKEIKEVIELPIKHPELFESLGIAQPKGVLLYGPPGTGKTLLARAVAHHTDCTFIRVSGSELVQKYIGEGSRMVRELFVMAREHAPSIIFMDEIDSIGSARMESGTGNGDSEVQRTMLELLNQLDGFEASNKIKVLMATNRIDILDQALLRPGRIDRKIEFPNPNEESRFDILKIHSRKMNLMRGIDLKKIAEKMSGASGAELKAVCTEAGMFALRERRVHVTQEDFEMAVAKVMKKETEKNMSLRKLWK

SEQ ID NO: 7797 - protein, 178 aa, Fraxinus spp
MVRELFVMAREHAPSIIFMDEIDSIGSARMESGSGNGDSEVQRTMLELLNQLDGFEASNKIKVLMATNRIDILDHALLRPGRIDRKIEFPNPNGESRQDILKIHSRKMNLMRGIDLKKIAEKMNGASGAELKAVCTEAGMFALRERRVHVTQEDFEMAVAKVMKKETDKNMSLRKLWK

SEQ ID NO: 7798 - protein, 412 aa, Zostera marina
MAAMELETNVVDIHSPTKVRGEEGLRKYYMQHIHDLQLQSRQKSDNFNRLKAQRNDLNTKVRMLREELQLLHEPGSYVGEVIKVMGKSKVLVKVHPEGKYIVDVDKNIDITKITPSARVALRNDSYVLHLILPSKVDPLVNLMKVEKVPDSTYDMIGGLDQQIKEIKEVIELPIKHPELFESLGIAQPKGVLLYGPPGTGKTLLARAVAHHTDCTFIRVSGSELVQKYIGEGSRMVRELFVMAREHAPSIIFMDEIDSIGSARMESGSGNGDSEVQRTMLELLNQLDGFEASNKIKVLMATNRIDILDQALLRPGRIDRKIEFPNPNEESRWDILKIHSRKMNLMRGIDLKKIAAKLNGASGAELKAVCTEAGMYALRERRVHVTQEDFEMSVAKVMKKDAEKNMSLRKLWK

SEQ ID NO: 7799 - protein, 411 aa, Beta vulgaris
MATALTERNTPATMGGSTTHGDGLRQYYLKRINGLEHLHRQKTLDLSRLEAHRNELNSQVRMLKEELMLLQEPGSYVGEVVKVMGKSKVLVKVHPEGKYVVDVDKSIDITKLTPSTRVALRNDSYVLHLVLPSKVDPLVNLMKVEKVPDSTYDMIGGLDQQIKEIKEVIELPIKHPELFESLGIAQPKGVLLYGPPGTGKTLLARAVAHHTDCTFIRVSGSELVQKYIGEGSRMVRELFVMAREHAPSIIFMDEIDSIGSARMESGSGNGDSEVQRTMLELLNQLDGFEASKKIKVLMATNRIDILDPALLRPGRIDRKIEFPNPNEDSRCDILKIHSRKMNLMRGIDLKKIAEKMNGASGAELKAVCTEAGMFALRERRIHVTQEDFEMAVAKVMKKDTEKNMSLRKLWK

SEQ ID NO: 7800 - protein, 405 aa, Ceratodon purpureus
MGRAEEAPNRAVRSGEGLRHYYLSHIHDLLLQLRVKTHNLHRLEAQRNDLNSKVRMLREELQLLQEPGSYVGEVVKVMGKTKVLVKVHPEGKYVVDLDKSIDINKITPSTRVALRNDSYVLHLILPSKVDPLVNLMKVEKVPDSTYDMIGGLDQQIKEIKEVIELPIKHPELFESLGIAQPKGVLLYGPPGTGKTLLARAVAHHTDCTFIRVSGSELVQKYIGEGSRMVRELFVMAREHAPSIIFMDEIDSIGSARVESGNGNGDSEVQRTMLELLNQLDGFEASNKIKVLMATNRIDILDQALLRPGRIDRKIEFPNPTEESRLDILKIHSRKMNLMRGIDLKKIAEKMGGASGAELKAVCTEAGMFALRERRVHVTQEDFEMAVAKVMKKETDKNMSLKKLWK

SEQ ID NO: 7801 - protein, 423 aa, Podocarpus macrophillus
MQVEQIQPQLLKREIQPKEKYLSRESNKMVKQGEGLRQYYLQHIHDLQIQVRQKTHNLNRLEAQRNDLNSKVRMLREELQLLQEPGSYVGEVVKVMGKSKVLVKVHPEGKYVVDIDKNIDITKITPSTRVALRNDSYVLHLILPSKVDPLVNLMKVEKVPDSTYDMIGGLDQQIKEIKEVIELPIKHPELFESLGIAQPKGVLLYGPPGTGKTLLARAVAHHTDCTFIRVSGSELVQKYIGEGSRMVRELFVMAREHAPSIIFMDEIDSIGSARMESGTGNGDSEVQRTMLELLNQLDGFEASNKIKVLMATNRIDILDQALLRPGRIDRKIEFPNPNEESRWDILKIHSRKMNLMRGIDLKKIAEKMNGASGAELKAVCTEAGMFALRERRVHVTQEDFEMAVAKVMKKETEKNMSLRKLWK

SEQ ID NO: 7802 - protein, 422 aa, Artemisia annua
MATVDTLPMKPSDTNINKEPMFCSSTAPLEPGVDLKQYYTRHIYHLQNLRRKKANDLTRLEAQRNELNAKVRTLKEEIHLLQEPGSYVGEVVKVMGKSKVLVKVHPEGKYVVDIDNSIDITQLTPTTRVALRNDSYVLHLILPSKVDPLVNLMKVEKVPDSTYDMIGGLDQQIKEIKEVIELPIKHPELFESLGIAQPKGVLLYGPPGTGKTLLARAVAHHTDCTFIRVSGSELVQKYIGEGSRMVRELFVMAREHAPSIIFMDEIDSIGSARMESGSGNGDSEVQRTMLELLNQLDGFEASNKIKVLMATNRIDILDQALLRPGRIDRKIEFPNPNEDSRADILRIHSRKMNLMRGIDLKKIAEKMNGASGAELKAVCTEAGMFALRERRVHVTQEDFEMAVAKVMKKETEKNMSLRKLWK

SEQ ID NO: 7803 - protein, 396 aa, Ambrosia trifida
MDSKPGDGLKQYYQQHIHDAQLQVRHKTNNLNRLQAQRNDLNSKVRMLKEELQLLQEPGSYVGEVVKVMGKSKVLVKVHPEGKYVVDIDKSIDITKITPSTRVALKNDSYVLHLVLPSKVDPLVNLMKVEKVPDSTYDMIGGLDQQIKEIKEVIELPIKHPELFESLGIAQPKGVLLYGPPGTGKTLLARAVAHHTDCTFIRVSGSELVQKYIGEGSRMVRELFVMAREHAPSIIFMDEIDSIGSARMESGSGNGDSEVQRTMLELLNQLDGFEASNKIKVLMATNRIDILDQALLRPGRIDRKIEFPNPNEDSRFDILKIHSRKMNLMRGIDLKKIAEKMNGASGAELKAVCTEAGMFALRERRVHVTQEDFEMAVAKAMKKDTEKNMSLRKLWK

SEQ ID NO: 7804 - protein, 394 aa, Ambrosia trifida
SKPGDGLKQYYQQHIHDAQLQVRHKTNNLNRLQAQRNDLNSKVRMLKEELQLLQEPGSYVGEVVKVMGKSKVLVKVHPEGKYVVDIDKSIDITKITPSTRVALKNDSYVLHLVLPSKVDPLVNLMKVEKVPDSTYDMIGGLDQQIKEIKEVIELPIKHPELFESLGIAQPKGVLLYGPPGTGKTLLARAVAHHTDCTFIRVSGSELVQKYIGEGSRMVRELFVMAREHAPSIIFMDEIDSIGSARMESGSGNGDSEVQRTMLELLNQLDGFEASNKIKVLMATNRIDILDQALLRPGRIDRKIEFPNPNEDSRFDILKIHSRKMNLMRGIDLEKIAEKMNGASGAELKAVCTEAGMFALRERRVHVTQEDFEMAVAKVMKKDTEKNMSLRKLWK

SEQ ID NO: 7805 - protein, 429 aa, Nuphar advena
MAVAEVGRMTDLQKSKQFDSDAEVDRVSSEESTRMVKHGEGLRQYYLQHIHDLQLQVRQKSHNLNRLEAQRNELNSRVRMLREELQLLQEPGSYVGEVVKVMGKSKVLVKVHPEGKYVVDIDKNIDITKITPSTRVALRNDSYVLHLILPSKVDPLVNLMKVEKVPDSTYDMIGGLDQQIKEIKEVIELPIKHPELFESLGIAQPKGVLLYGPPGTGKTLLARAVAHHTDCTFIRVSGSELVQKYIGEGSRMVRELFVMAREHAPSIIFMDEIDSIGSARMESGTGNGDSEVQRTMLELLNQLDGFEASNKIKVLMATNRIDILDQALLRPGRIDRKIEFPNPNEESRFDILKIHSRKMNLMRGIDLKKIAEKMNGASGAELKAVCTEAGMFALRERRVHVTQEDFEMAVAKVMKKETEKNMSLRKLWK

SEQ ID NO: 7806 - protein, 338 aa, Fagus grandifolia
MAIETKHPEAVPADETCSAKCSKQGEGLKQYYLQHIHEHQLQVRQKTHNLNRLEAQRNEFNSRVRMLREELQLLQEPGSYVGEVVKVMGKNKVLVKVHSEGKYVVDIDKNIDITKITPSTRVALRNDSYVLHLILPSKVDPLVNLMKVEKVPDSTYDMIGGLDQQIKEIKEVIELPIKHPELFLESLGIAQPKGVLLYGPPGTGKTLLARAVAHHTDCTFIRVSGSELVQKYIGEGSRMVRELFVMAREHAPSIIFMDEIDSIGSARMESGSGNGDSEVQRTMLELLNQLDGFEASNKLRFLCLQIVLIFSIKLSLGQGELIGRLNFLILTGSLDLIF

SEQ ID NO: 7807 - protein, 404 aa, Beta vulgaris
MATAEVEKKTVKQGEGLRQYYLQHIHELQLRIRDKSHNLQRLEAQRNELNSRVRALKEELQLLQEPGSYVGEVVKVMGKSKVLVKVHPEGKYVVDIDKNIDITKLTPSTRVALRNDSYVLHLVLPSKVDPLVNLMKVEKVPDSTYDMIGGLDQQIKEIKEVIELPIKHPELFESLGIAQPKGVLLYGPPGTGKTLLARAVAHHTDCTFIRVSGSELVQKYIGEGSRMVRELFVMAREHAPSIIFMDEIDSIGSTRMESGSGNGDSEVQRTMLELLNQLDGFEASNKIKVLMATNRIDILDPALLRPGRIDRKIEFPNPNEESRFDILKIHSRRMNLMRGIDLKKIGEKMNGASGAELKAVCTEAGMFALRERRIHVTQEDFEMAVAKVMKKDTDKNMSLRKLWK

SEQ ID NO: 7808 - protein, 399 aa, Amborella trichopoda
  misc_feature (47)..(47): Xaa can be any naturally occurring amino acid
  misc_feature (49)..(49): Xaa can be any naturally occurring amino acid
  misc_feature (221)..(221): Xaa can be any naturally occurring amino acid
  misc_feature (294)..(294): Xaa can be any naturally occurring amino acid
  misc_feature (299)..(300): Xaa can be any naturally occurring amino acid
  misc_feature (303)..(303): Xaa can be any naturally occurring amino acid
NSEKMVKQGEGLRQYYVQHIHDLQLQVRQKTHNLNRLEAQRNDLNSXVXMLREELQLLQEPGSYVGEVVKVMGKSKVLVKVHPEGKYVVDIDKNIDITKITPSTRVALRNDSYVLHLILPSKVDPLVNLMKVEKVPDSTYDMIGGLDQQIKEIKEVIELPIKHPELFESLGIAQPKGVLLYGPPGTGKTLLARAVAHHTDCTFIRVSGSELVQKYIGEGSXMVRELFVMAREHAPSIIFMDEIDSIGSARMESGTGNGDSEVQRTMLELLNQLDGFEASNKIKVLMATNRIDIXDQALXXPGXIDRKIEFPNPNEEFRLDILKIHSRKMNLMRGIDLKKIAEKMNGASGAELKAVCTEAGMFAFRERRVHVTQEDFEMAVAKVMKKETEKNMSLRKLWK

SEQ ID NO: 7809 - protein, 178 aa, Secale cereale
MVRELFVMAREHAPSIIFMDEIDSIGSARMESGSGNGDSEVQRTMLELLNQLDGFEASNKIKVLMATNRIDILDQALLRPGRIDRKIEFPNPNADSRGDILKIHSRKMNLMRGIDLKKIAEKMNGASGAELKAVCTEAGMFALRERRVHVTQEDFEMAVAKVMKKDTEKNMSLRKLWK

SEQ ID NO: 7810 - protein, 433 aa, Abies balsamea
MRVEELGGILRQASDLEAAANAKEKLKQKHQIPKESNRMVKQGEGLRQYYLQHIHDLQLQVRQKTHNLNRLEAQRNDLNSKVRALREELQLLQEPGSYVGEVVKVMGKSKVLVKVHPEGKYVVDVDKNIDITKITPSTRVALRNDSYVLHLILPSKVDPLVNLMKVEKVPDSTYDMIGGLDQQIKEIKEVIELPIKHPELFESLGIAQPKGVLLYGPPGTGKTLLARAVAHHTDCTFIRVSGSELVQKYIGEGSRMVRELFVMAREHAPSIIFMDEIDSIGSARMESGTGNGDSEVQRTMLELLNQLDGFEASNKIKVLMATNRIDILDQALLRPGRIDRKIEFPNPNEESRFDILKIHSRKMNLMRGIDLKKIAEKMSGASGAELKAVCTEAGMFALRERRVHVTQEDFEMAVAKVMKKETEKNMSLRKLWK

SEQ ID NO: 7811 - protein, 404 aa, Silene vulgaris
MATAEVEKKAVKQGEGLRQYYVQRIHERQLEARTKTFNLQRLEAQRNELNSRVRALKEELQLLQEPGSYVGEVVKVMGKSKVLVKVHPEGKYVVDIDKNIDITKLTPSTRVALRNDSYVLHLILPSKVDPLVNLMKVEKVPDSTYDMIGGLDQQIKEIKEVIELPIKHPELFESLGIAQPKGVLLYGPPGTGKTLLARAVAHHTDCTFIRVSGSELVQKYIGEGSRMVRELFVMAREHAPSIIFMDEIDSIGSARMESGSGNGDSEVQRTMLELLNQLDGFEASNKIKVLMATNRIDILDPALLRPGRIDRKIEFPNPNEDSRADILKIHSRKMNLMRGIDLKKIAEKMNGASGAELKAVCTEAGMFALRERRIHVTQEDFEMAVAKVMKKDTDKNMSLRKLWK

SEQ ID NO: 7812 - protein, 433 aa, Pseudotsuga menziesii
MRVEELGGILRQASDLEAAANAKEKLKEKHQFPKESNRMVKQGEGLRQYYLQHIHDLQLQVRQKTHNLNRLEAQRNDLNSKVRALREELQLLQEPGSYVGEVVKVMGKSKVLVKVHPEGKYVVDVDKNIDITKITPSTRVALRNDSYVLHLILPSKVDPLVNLMKVEKVPDSTYDMIGGLDQQIKEIKEVIELPIKHPELFESLGIAQPKGVLLYGPPGTGKTLLARAVAHHTDCTFIRVSGSELVQKYIGEGSRMVRELFVMAREHAPSIIFMDEIDSIGSARMESGTGNGDSEVQRTMLELLNQLDGFEASNKIKVLMATNRIDILDQALLRPGRIDRKIEFPNPNEESRFDILKIHSRKMNLMRGIDLKKIAEKMSGASGAELKAVCTEAGMFALRERRVHVTQEDFEMAVAKVMKKETEKNMSLRKLWK

SEQ ID NO: 7813 - protein, 434 aa, Sciadopitys verticillata
MEVDAAGRKFIDFLGPPAAIPKEKLKEKQEYQNSKESNKMVKQGEGLRQYYMQHIHDLQIQVRQKTHNLNRLEAQRNDLNSKVRMLREELQLLQEPGSYVGEVVKVMGKSKVLVKVHPEGKYVVDIDKNIDITKITPSTRVALRNDSYVLHLILPSKVDPLVNLMKVEKVPDSTYDMIGGLDQQIKEIKEVIELPIKHPELFESLGIAQPKGVLLYGPPGTGKTLLARAVAHHTDCTFIRVSGSELVQKYIGEGSRMVRELFVMAREHAPSIIFMDEIDSIGSARMESGSGNGDSEVQRTMLELLNQLDGFEASNKIKVLMATNRIDILDQALLRPGRIDRKIEFPNPNEESRWDILKIHSRKMNLMRGIDLKKIAEKMNGASGAELKAVCTEAGMFALRERRVHVTQEDFEMAVAKVMKKETEKNMSLRKLWK

SEQ ID NO: 7814 - protein, 403 aa, Cicer arietinum
MATVGVEVKQAQGALEENCSAKPTKSGEGLRQYYSQHIHDLQLLLRQKTHNLNRLEAQRNDLNSRVRMLREELQLLQEPGSYVGEVVKVMGKSKVLVKVHPEGKYVVDIDKNIDITKLTPSTRVALRNDSYVLHLVLPSKVDPLVNLMKVEKVPDSTYDMIGGLDQQIKEIKEVIELPIKHPELFESLGIAQPKGVLLYGPPGTGKTLLARAVAHHTDCTFIRVSGSELVQKYIGEGSRMVRELFVMAREHAPSIIFMDEIDSIGSARMESGSGNGDSEVQRTMLELLNQLDGFEASNKIKVLMATNRIDILDQALLRPGRIDRKIEFPNPNEESRLDIVKIHSRRMNLMRGIDLKKIAEKMNGASGAELKAVCTEAGMFALRERRIHVAQEDFEMSVAKVMK

SEQ ID NO: 7815 - protein, 410 aa, Physcomitrella patens
MGRAEEVPNKSARSGEGLRHYYLSHIHDLLLQLRVKTHNLHRLEAQRNDLNSKVRMLREELQLLQEPGSYVGEVVKVMGKTKVLVKVHPEGKYVVDLDKSIDINKITPTTRVALRNDSYVLHLILPSKVDPLVNLMKVEKVPDSTYDMIGGLDQQIKEIKEVIELPIKHPELFESLGIAQPKGVLLYGPPGTGKTLLARAVAHHTDCTFIRVSGSELVQKYIGEGSRMVRELFVMAREHAPSIIFMDEIDSIGSARVESGNGNGDSEVQRTMLELLNQLDGFEASNKIKVLMATNRIDILDQALLRPGRIDRKIEFPNPTEESRLDILKIHSRKMNLMRGIDLKKIAEKMGGASGAELKAITGPAVCTEAGMFALRERRVHVTQEDFEMSVAKVMKKDTDKNMSLKKLWK

SEQ ID NO: 7816 - protein, 364 aa, Flaveria ramosissima
MATAEIAMNTSDSGEKEDSYLSRHTGSKPGEGLKQYYQQHIHDAQLQVRQKTHNLNRLEAQRNELNSRVRMLKEELQMLQEPGSYVGEVVKVMGKSKVLVKVHPEGKYVVDIDKSIDITKITPSTRVALKNDSYVLHLVLPSKVDPLVNLMKVEKVPDSTYDMIGGLDQQIKEIKEVIELPIKHPELFESLGIAQPKGVLLYGPPGTGKTLLARAVAHHTDCTFIRVSGSELVQKYIGEGSRMVRELFVMAREHAPSIIFMDEIDSIGSARMESGSGNGDSEVQRTMLELLNQLDGFEASNKIKVLMATNRIDILDQALLRPGRIDRKIEFPNPNEDSRFDILKIHSRKMNLMRGIDLKKSPRR

SEQ ID NO: 7817 - protein, 622 aa, Arabidopsis lyrata
MAAVEVDSRRPETAMEETCNVKGAAAKQGEGLKQYYLQHIHELQRQLRQKTNNLNRLEAQRNELNSRVRMLREELQLLQEPGSYVGEVVKVMGKNKVLVKVHPEGKYVVDIDKSIDITKITPSTRVALRNDSYVLHLVLPSKVDPLVNLMKVEKVPDSTYDMIGGLDQQIKEIKEVIELPIKHPELFESLGIAQPKGVLLYGPPGTGKTLLARAVAHHTDCTFIRVSGSELVQKYIGEGSRMVRELFVMAREHAPSIIFMDEIDSIGSARMESGSGNGDSEVQRTMLELLNQLDGFEASNKIKVLMATNRIDILDQALLRPGRIDRKIEFPNPNEESRFDILKIHSRKMNLMRGIDLKKIAEKMNGASGAELKAVCTEAGMFALRERRVHVTQEDFEMAVAKALPNQQTVDYPSFKLVIVGDGGTGKTTFVKRHLTGEFEKKYEPTIGVEVHPLDFFTNCGKIRFYCWDTAGQEKFGGLRDGYYIHGQCAIIMFDVTARLTYKNVPTWHRDLCRVCENIPIVLCGNKVDVKNRQVKAKQVTFHRKKNLQYYEISAKSNYNFEKPFLYLARKLAGDQNLHFVETPALAPPEVHIDIADQQKNEAELLQAAAQPLPDDDDDVFE

SEQ ID NO: 7818 - protein, 431 aa, Papaver somniferum
MAAAEVQRKQIVQRKHIESNGSSFIDAINLKNAMMAKNKPGEGLRQYYLQHIHDLQLQVRQKSHNLNRLEAQRNDLNSRVRMLKEELQLLQEPGSYVGEVVKVMGKSKVLVKVHPEGKYVVDIDKSIDITKITPTTRVALRNDSYVLHLVLPSKVDPLVNLMKVEKVPDSTYDMIGGLDQQIKEIKEVIELPIKHPELFESLGIAQPKGVLLYGPPGTGKTLLARAVAHHTDCTFIRVSGSELVQKYIGEGSRMVRELFVMAREHAPSIIFMDEIDSIGSARMESGTGNGDSEVQRTMLELLNQLDGFEASNKIKVLMATNRIDILDPALLRPGRIDRKIEFPNPNEESRWDILKIHSRRMNLMRGIDLKKIAEKMGGASGAELKAVCTEAGMFALRERRVHVTQEDFEMAVAKVMKKETDKNMSLRKLWK

SEQ ID NO: 7819 - protein, 433 aa, Cryptomeria japonica
MRVDEELGAAFPNTDSTGAINSMGTLKEKQQEQIKNKKMVKQGEGLRQYYMQHIHDLQLQVRQKTHNLNRLEAQRNDLNSKVRALREELQLLQEPGSYVGEVVKVMGKSKVLVKVHPEGKYVVDIDKNIDITKITPSTRVALRNDSYVLHLILPSKVDPLVNLMKVEKVPDSTYDMIGGLDQQIKEIKEVIELPIKHPELFESLGIAQPKGVLLYGPPGTGKTLLARAVAHHTDCTFIRVSGSELVQKYIGEGSRMVRELFVMAREHAPSIIFMDEIDSIGSARMESGSGNGDSEVQRTMLELLNQLDGFEASNKIKVLMATNRIDILDQALLRPGRIDRKIEFPNPNEESRWDILKIHSRKMNLMRGIDLKKIAEKMNGASGAELKAVCTEAGMFALRERRVHVTQEDFEMAVAKVMKKETEKNMSLRKLWK

SEQ ID NO: 7820 - protein, 405 aa, Actinidia deliciosa
  misc_feature (317)..(317): Xaa can be any naturally occurring amino acid
MATAAIEPIQTDTASSGETCFSKTSSSKQGEGLRQYYLQHIHDLQLHVRQKTHNLNRLEAQRNDLNSKVRMLKEELQLLQEPGSYVGEVVKVMGKSKVLVKVHPEGKYVVDIDKNIDITKLTPSSRVALRNDSYVLHLVLPSKVDPLVNLMKVEKVPDSTYDMIGGLDQQIKEIKEVIELPIKHPELFESLGIAQPKGVLLYGPPGTGKTLLARAVAHHTDCTFIRVSGSELVQKYIGEGSRMVRELFVMAREHAPSIIFMDEIDSIGSARMESGSGNGDSEVQRTMLELLNQLDGFEASNKIKVLMATNRIDILDXALLRPGRIDRKIEFPNPNEESRWDILKIHSRKMNLMRGIDLKKIAEKMNGASGAELKAVCTEAGMFALRERRVHVTQEDFEMAVAKVM

SEQ ID NO: 7821 - protein, 434 aa, Cycas rumphii
MQVEELGGILIQASDSEANISTNTKDKFKEKHGSKDLPRMVKQGEGLRQYYLQHIHDLQLQVRQKTHNLNRLEAQRNDLNSKVRMLREELQLLQEPGSYVGEVVKVMGKSKVLVKVHPEGKYVVDIDKNIDITKITPSTRVALRNDSYVLHLILPSKVDPLVNLMKVEKVPDSTYDMIGGLDQQIKEIKEVIELPIKHPELFESLGIAQPKGVLLYGPPGTGKTLLARAVAHHTDCTFIRVSGSELVQKYIGEGSRMVRELFVMAREHAPSIIFMDEIDSIGSARMESGTGNGDSEVQRTMLELLNQLDGFEASNKIKVLMATNRIDILDQALLRPGRIDRKIEFPNPNEESRWDILKIHSRKMNLMRGIDLKKIAEKMNGASGAELKAVCTEAGMFALRERRVHVTQEDFEMAVAKVMKKETEKNMSLKKLWK

SEQ ID NO: 7822 - protein, 396 aa, Selaginella moellendorffii
GMGRCGEGFHDYYTSRIHDASQQLRIKGNNLARLEAQRNDLNSKVRMLREELQLLQEPGSYVGEVVKVMGKSKVLVKVHPEGKYVVDVDKSIDMSKITPTTRVALRNDSYVLHLILPSKVDPLVNLMKVEKVPDSTYDMIGGLDQQIKEIKEVIELPIKHPELFESLGIAQPKGVLLYGPPGTGKTLLARAVAHHTDCTFIRVSGSELVQKYIGEGSRMVRELFVMAREHAPSIIFMDEIDSIGSSRMESGNGNGDSEVQRTMLELLNQLDGFEASNKIKVLMATNRIDILDPALLRPGRIDRKIEFPNPTEESRLDILKIHSRKMNLMRGIDLKKIAEKMNGASGAELKAVCTEAGMFALRERRVHVTQEDFDMAVAKVMKKETEKNMSLRKLWK

SEQ ID NO: 7823 - protein, 395 aa, Selaginella moellendorffii
MGRCGEGFHDYYTSRIHDASQQLRIKGNNLARLEAQRNDLNSKVRMLREELQLLQEPGSYVGEVVKVMGKSKVLVKVHPEGKYVVDVDKSIDMSKITPTTRVALRNDSYVLHLILPSKVDPLVNLMKVEKVPDSTYDMIGGLDQQIKEIKEVIELPIKHPELFESLGIAQPKGVLLYGPPGTGKTLLARAVAHHTDCTFIRVSGSELVQKYIGEGSRMVRELFVMAREHAPSIIFMDEIDSIGSSRMESGNGNGDSEVQRTMLELLNQLDGFEASNKIKVLMATNRIDILDPALLRPGRIDRKIEFPNPTEESRLDILKIHSRKMNLMRGIDLKKIAEKMNGASGAELKAVCTEAGMFALRERRVHVTQEDFDMAVAKVMKKETEKNMSLRKLWK

SEQ ID NO: 7824 - protein, 435 aa, Solanum phureja
MASVDVEKSRSDMEREEACSAKPTKQGEGLRQYYMQHIHDLQLQVRVKTHNLNRLEAQRNELNSKVRMLKEELQLLQEPGSYVGEVVKVMGKSKVLVKVHPEGKYVVDIGKNIDITKITPSTRVALRNDSYVLHLILPSKVDPLVNLMKVEKVPDSTYDMIGGLDQQIKEIKEVIELPIKHPELFESLGIAQPKGVLLYGPPGTGKTLLARAVAHHTDCTFIRVSGSELVQKYIGEGSRMVRELFVMAREHAPSIIFMDEIDSIGSARMESGSGNGDSEVQRTMLELLNQLDGFEASNKIKASSACCFNCILLGYNFIDVLMATNRIDILDQALLRPGRIDRKIEFPNPNEESRQDILKIHSRKMNLMRGIDLKKIAEKMSGASGAELKAVCTEAGMFALRERRVHVTQEDFEMAVAKVMKKETEKNMSLRKLWK

SEQ ID NO: 7825 - protein, 433 aa, Picea glauca
MRVEEPGGILRQASDLEAAANAKEKLKEKQQLLKESNKMVKQGEGLRQYYLQHIHDLQLQVRQKTHNLNRLEAQRNDLNSKVRALREELQLLQEPGSYVGEVVKVMGKSKVLVKVHPEGKYVVDVDKNIDITKITPSTRVALRNDSYVLHLILPSKVDPLVNLMKVEKVPDSTYDMIGGLDQQIKEIKEVIELPIKHPELFESLGIAQPKGVLLYGPPGTGKTLLARAVAHHTDCTFIRVSGSELVQKYIGEGSRMVRELFVMAREHAPSIIFMDEIDSIGSARMESGTGNGDSEVQRTMLELLNQLDGFEASNKIKVLMATNRIDILDQALLRPGRIDRKIEFPNPNEESRFDILKIHSRKMNLMRGIDLKKIAEKMSGASGAELKAVCTEAGMFALRERRVHVTQEDFEMAVAKVMKKETEKNMSLRKLWK

SEQ ID NO: 7826 - protein, 435 aa, Solanum lycopersicum
MASVDVEKRRSDMEREEACSAKPTKQGEGLRQYYMQHIHDLQLQVRVKTHNLNRLEAQRNELNSKVRMLKEELQLLQEPGSYVGEVVKVMGKSKVLVKVHPEGKYVVDIGKNIDITKITPSTRVALRNDSYVLHLILPSKVDPLVNLMKVEKVPDSTYDMIGGLDQQIKEIKEVIELPIKHPELFESLGIAQPKGVLLYGPPGTGKTLLARAVAHHTDCTFIRVSGSELVQKYIGEGSRMVRELFVMAREHAPSIIFMDEIDSIGSARMESGSGNGDSEVQRTMLELLNQLDGFEASNKIKASSACCFNCILLGYNFFDVLMATNRIDILDQALLRPGRIDRKIEFPNPNEESRQDILKIHSRKMNLMRGIDLKKIAEKMSGASGAELKAVCTEAGMFALRERRVHVTQEDFEMAVAKVMKKETEKNMSLRKLWK

SEQ ID NO: 7827 - protein, 350 aa, Euphorbia peplus
MLREELQLLQEPGSYVGEVVKVMGKNKVLVKVHPEGKYVVDIDKSIDITKITPSTRVALRNDSYVLHLVLPSKVDPLVNLMKVEKVPDSTYDMIGGLDQQIKEIKEVIELPIKHPELFESLGIAQPKGVLLYGPPGTGKTLLARAVAHHTDCTFIRVSGSELVQKYIGEGSRMVRELFVMAREHAPSIIFMDEIDSIGSARMESGSGNGDSEVQRTMLELLNQLDGFEASNKIKVLMATNRIDILDQALLRPGRIDRKIEFPNPNEESRQDILKIHSRRMNLMRGIDLKKIAEKMNGASGAELKAVCTEAGMFALRERRVHVTQEDFEMAVAKVMKKETEKNMSLRKLWK

SEQ ID NO: 7828 - protein, 366 aa, Humulus lupulus
LNRLEAQRNELNSRVRMLREELQLLQEPGSYVGEVVKVMGKNKVLVKVHPEGKYVVDIDKSIDITKITPSTRVALRNDSYVLHLVLPSKVDPLVNLMKVEKVPDSTYDMIGGLDQQIKEIKEVIELPIKHPELFESLGIAQPKGVLLYGPPGTGKTLLARAVAHHTDCTFIRVSGSELVQKYIGEGSRMVRELFVMAREHAPSIIFMDEIDSIGSARMESGSGNGDSEVQRTMLELLNQLDGFEASNKIKVLMATNRIDILDQALLRPGRIDRKIEFPNPNGDSRFDILKIHSRRMNLMRGIDLKKIAEKMNGASGAELKAVCTEAGMFALRERRVHVTQEDFEMAVAKVMKKDTEKNMSLRKLWK

SEQ ID NO: 7829 - protein, 395 aa, Pteridium aquilinum
MGREGDGLRQYYIAHINELNLQLRQKMHNLNRLEAQRNDYNARVRMLKEELQLLQEPGSYVGEVVKVMGKKKVLVKVHPEGKYVVDIDKDIDITKITPSTRVALRNDSYVLHLILPSKVDPLVNLMKVEKVPDSTYDMIGGLDQQIKEIKEVIELPIKHPELFESLGIAQPKGVLLYGPPGTGKTLLARAVAHHTDCTFIRVSGSELVQKYIGEGSRMVRELFVMAREHAPSIIFMDEIDSIGSARMESGNGNGDSEVQRTMLELLNQLDGFEASNKIKVLMATNRIDILDHALLRPGRIDRKIEFPNPTEESRCDILKIHSRKMNLMRGIDLKKIAEKMTGASGAELKSVCTEAGMFALRERRVHVTQEDFDMAVAKVMKKETEKNMSLKKLWK

SEQ ID NO: 7830 - protein, 378 aa, Sequoia sempervirens
PAASGPSKDYTILTVLEAQRNDLNSKVRMLREELQLLQEPGSYVGEVVKVMGKSKVLVKVHPEGKYVVDVDKNIDITKITPSTRVALRNDSYMLHLILPSKVDPLVNLMKVEKVPDSTYDMIGGLDQQIKEIKEVIELPIKHPELFESLGIAQPKGVLLYGPPGTGKTLLARAVAHHTDCTFIRVSGSELVQKYIGEGSRMVRELFVMAREHAPSIIFMDEIDSIGSTRMESGSGNGDSEVQRTMLELLNQLDGFEASNKIKVLMATNRIDILDQALLRPGRIDRKIEFPNPNEESRWDILKIHSRKMNLMRGIDLKKIAEKMNGASGAELKAVCTEAGMFALRERRVHVTQEDFEMAVAKVMKKETEKNMSLRKLWK

SEQ ID NO: 7831 - protein, 397 aa, Silene vulgaris
KTMLNQPEGFSQYFAHRIHERSLEALTKTFNLQRLHAQRNDLNSRVRSVKEEIQLLQVPGSYVGEVVKVMGKSRVLVKVHPEGEYVVDIDKNIDISKLTPSTRVALRNDSYVLHLILPSKVDPLVNLMKVEKVPDSTYDMIGGLDQQIKEIKEVIELPIKHPELFESLGIAQPKGVLLYGPPGTGKTLLARAVAHHTDCTFIRVSGSELVQKYIGEGSRMVRELFVMAREHAPSIIFMDEIDSIGSARMESGSGNGDSEVQRTMLELLNQLDGFEASNKIKVLMATNRIDILDQALLRPGRIDRKIEFPNPNEDSRGDILKIHSRKMNLMRGIDLKKIAEKMNGASGAELKAVCTEAGMFALRERRIHVTQEDFEMAVAKVMKKDTDKNMSLRKLWK

SEQ ID NO: 7832 - protein, 346 aa, Papaver somniferum
MAAVEVQRKHIESNGGNSSFIDAINLKNAMTAKHKPGEGLRQYYLQHIHDLQLQVRQKSHNLNRLEAQRNDLNSRVRMLKEELQLLQEPGSYVGEVVKVMGKSKVLVKVHPEGKYVVDIDKSIDITKTYPTTRVALRNDSYVLHLVLPSKVDPLVNLMKVEKVPDSTYDMIGGLDQQIKEIKEVIELPIKHPELFESLGIAQPKGVLLYGPPGTGKTLLARAVAHHTDCTFIRVSGSELVQKYIGEGSRMVRELFVMAREHAPSIIFMDEIDSIVSARMESGTGNGDSVVQRTMLELLNQFEASNKIKVLMATNSIDILDPALLRPGRIGGKKSFQILARSLDGIF

SEQ ID NO: 7833 - protein, 367 aa, Zea mays
MAMSFHFHPLAASRVHFSPLPFAAAAGAPSPSSSVAIAAHHQHGRRRFSAIVATAAAASAATTEFDFKAYMGERAVAVNRALDAAVPAGEPPAALHDAMRYALLAGGKRVRPALCLAACAVVGGPEPWAMPAAAAVEMVHTMSLVHDDLPCMDDDDLRRGKPTCHVVYGEPIAVLAGDALLSLSFHHMASVGSYPPDVDPEKHPARVVRAIGELARCIGSEGLVAGQVVDLEMTGTSETVPLERLEYIHLHKTAALLEASVVIGAIIGGGTDEQIERLRKYARSIGLLFQVVDDILDVTKSSEELGKTAGKDLASDKTTYPKLLGLEKSREFAEELLSDAVEQLACFDKEKAAPLLHLANYIAHRQN

SEQ ID NO: 7834 - protein, 363 aa, Zea mays
MAMAFHFHPLVASRVHFSPLPFAAATGAPSPSSSVAIAAHYHHHGRRRFSAIVATATTTEFNFKAYMEERAVAVNRALDAAIPAGGLPAALHDAMRYALLAGGKRVRPALCLAACAVVGGPESWAMPAAAAVEMVHTMSLVHDDLPCMDDDDLRRGKPTCHVVYGEPIAVLAGDALLSLSFHHMASVGSYPPAVDPEKHPARVVRAIGELARCIGSEGLVAGQVVDLEMTGTSQTVPLELLEYIHLHKTAALLEASVVIGAIIGGGTDEQIEALRKYARSIGLLFQVVDDILDVTKSSEELGKTAGKDLASDKTTYPKLLGLAKSREFAEKLVSDATEQLACFDEEKAAPLLHLANYIAHRQN

SEQ ID NO: 7835 - protein, 359 aa, Setaria italica
MAMAFHPLAASRVRLAPLLPGAAAAPSPASVAAHHHHHRRRFSAIVATAAASATTEFDFKSYMGSRAEAVNRALDAAIPAGEDPVSLHEAMRYALLAGGKRVRPALCLAACGVAGGREAWALAPAAAVEMVHTMSLVHDDLPCMDDDDLRRGKPTCHVVYGEPIAVLAGDALLSLAFHHMASVGSYPPDVDPDKHPARVVRAIGELARCIGSEGLVAGQVVDLEMTGTSEIVPLERLEYIHLHKTAALLEASVVIGAIIGGATDEQIERLRKYARSIGLLFQVVDDILDVTKSSEELGKTAGKDLASDKTTYPKLLGLDKSREFAEKLLSDAKEQLAGFDKEKAAPLLHLAYYIAHRQN

SEQ ID NO: 7836 - protein, 356 aa, Brachypodium distachyon
MAAFHPLVASRVHLSPLLPAAAGPAAAVAAGLSFHRRRFSAIVAAATAPTATEFDFKAYMGERAVAVNQALDAAIPAGEPPAALHDAMRYALLAGGKRVRPALCLASCVVVGGREAWAMAPAAAVEMVHTMSLVHDDLPCMDDDDLRRGKPTCHVVYGEPIAVLAGDALLSLSFGHMASMDSYPPDVDPEKHPARVVRGIGELARCIGSEGLVAGQVVDLEMTGSTETVPLDRLEYIHLHKTAALLEASVVIGAIIGGGSDEQIERLRKYARSIGLLFQVVDDILDVTKSSEELGKTAGKDLASDKTTYPKLLGLEKSREFAEKLLCDAKEQLADFDKEKAAPLLYLANYIAYRQN

SEQ ID NO: 7837 - protein, 434 aa, Panicum virgatum
RKKCASLHPTTTARAATPLPLTRPRPCPALPRPASKASLHLKIRGSQHLGATPNLHLTPSPPEAVRHSPPMAMAFQTLAASRVRVGPLLPAAAAAAPTPSSVAAPRHHPRRRFSAIVAVAPAAAPAAAPAEFDFDSYMTERSEMVNRALDAAIPEGEPPAALHEAMRYTLLAGGKRVRPALCLAACGVVGGREEWALAPAAAVEMVHTMSLVHDDLLCMDDDDLRRGKPTCHVVYGEAIAVLTGDALLSLAFHHVASPGSYPPDVDPEKHPARVVRATFELARCIGSEGLVAGQVVDLANTGASEVVPLERLEYIHLHKTAALLEASVVMGAIMGGGTDEQIERLRKYARSIGLLFQVVDDILDVTKSSEELGKTAGKDLASDKATYPKLLGLEKSREFAEKLLSDAKEQLAGFDKEKAAPLLHLAYYIAHRQN

SEQ ID NO: 7838 - protein, 356 aa, Secale cereale
MAAFHPLVASRVRLTTPLLPVAAPAAAAAAGVSFHRRRFSAIVAAATAPAATGFDFNSYMGERAVAVNSALDAAVPAGEPPAALHDAMRYALLAGGKRVRPALCLAACVVSGGREAWAMAPAAAVEMVHTMSLVHDDLPCMDDDDLRRGKPTCHVVFGEPIAVLAGDALLALAFEHMASVDSYPPDVDPAKHTARVVRAIGELARCIGSEGLVAGQVVDLEMTGSTETVPLDRLEYIHLHKTAALLEASVVIGAIIGGGSEEQIERLRKYARSIGLLFQVVDDILDVTKSSEELGKTAGKDLASDKTTYPKLLGLEKSREFAEKLLSDAKEQLADFDKEKAAPLLYLANYIAYRQN

SEQ ID NO: 7839 - protein, 366 aa, Oryza sativa
MAAFPPLAASRVRISPLIPAAAMAGTAGAAAASYAQHRRRFCAIVATAAASPVPAAAAAAATGFDFNAYMGEKAAAVNRALDASIPADEPPAALHEAMRYALLAGGKRVRPALCLAACAVVGGREAWAMPAAAAVEMVHTMSLVHDDLPCMDDDDLRRGKPTCHVVYGEPIAVLTGDALLSLSFHHMARFDSYPPDIDADKHPARVVRAIGELARCIGSEGLVAGQVVDLEMTGSTETVPLERLEYIHLHKTAALLEASVVIGAILGGGSDEQIESLRMYARSIGLLFQVVDDILDVTKSSEELGKTAGKDLASDKTTYPKLLGLEKSREFAEKLLSDAREQLSGFDQETAAPLLHLANYIAYRQN

SEQ ID NO: 7840 - protein, 355 aa, Triticum aestivum
MAAFHPLVASRVRLATPLLPAAAPAAAAAGVSFHRRRFSAIVAAATAPAATGFDFNSYMGERAVAVNSALDAAVPAGEPPAALHDAMRYALLAGGKRVRPALCLAACVVSGGREAWAMAPAAAVEMVHTMSLVHDDLPCMDDDDLRRGKATCHVVYGEPIAVLAGDALLALAFEHMASVDSYPPDVDPAKHTARVVRAIGELARCIGSEGLVAGQVVDLEMTGSTETVPLDRLEYIHLHKTAALLEASVVIGAIIGGGSEEQIERLRKYARSIGLLFQVVDDILDVTKSSEELGKTAGKDLASDKTTYPKLLGLEKSREFAEKLLSDAKEQLADFDKEKAAPLLYLANYIAYRQN

SEQ ID NO: 7841 - protein, 285 aa, Triticum aestivum
MLRAVLKNNKKMWQECLPHIEFAYNHSLHSTTKMCPFEVVYGFLPRTPMDWWPLSSSEKVNFDAKQRAEWILKMHELTKENIERMNAKYKLAGDKGRKHVVFAPGDLVWLHLRKDRFPDLRKSKLMPRADGPFKVLEKINDNAYKLEPPADFGGCPTFNIADLKPYFGEEDELPMRTTSFQEGEDDKDINTIVTPTVPAAIHTGPITRARARQLNYQVLSFLGNDSNVHENMMLPKLDTFVLLTNEGPSLEKDEHWSKNKHGDDGMRKGNKNGVTSDDFRTLKPP

SEQ ID NO: 7842 - protein, 810 aa, Brassica rapa
APSTFMRLMNEVLRAFIGRFVVVYFDDILIYSKSLEEHLEHLRAVFIALRDARLFGNLGKCTFCTDRVSFLGYVVTPQGIEVDKAKIEAIESWPQPKTVTQVRSFLGLAGFYRRFVRDFRTIAATHNELTKKDVPFVWGTAQEEAFTVLKDKLTHAPLLQLPDFNKTFELECDASGIGLGGVLLQDGKPVAYFSEKLSGPSLNYSTYDKELYALVRTLETWQHYLWPKEFVIHSDHESLKHIKSQAKLNRRHAKWVEFIETFPYVIKHKKGKENVIADALSRRYTMLSQLDFKIFGLETIKDQYVHDADFKDVLQNCKEGRTWNKFVVNDGFVFRANKLCIPASSLRLLLLQEAHGGGLMGHFGVKKTEDVLATHFFWPKMRRDVERFVARCTTCQKAKSRLNPHGLYMPLPVPSVPWEDISMDFVLGLPRTKKGRDSIFVVVDRFSKMAHFIPCHKSDDAVNVADLFFHEIIHLHGVPNTIVLDRDTKFLSHFWRCLWAKLGTKLLFSTTCHPQTDGQTEVVNRTLSTMLRAVLKNNKKMWEECLPHIEFAYNRSLHSTTKMCPFEIVYGFLPRAPIDLLPLPSPEKVNFDAKQRAELILKMHELTKENIERMNAKYKLAGDKGRKHVVFAPGDLVWLHLRKDRFPDLRKSKLMPRADGPFKVLEKINDNAYKLELPADFGVSPTFNIADLKPYLGEEDELPSRTTSFQEGEDDEDINTIVTPTAPAAIHTGPITRARARQLNYQVLSFLGNDSNVHENMMLPKLDTFVLLTNEGPSFEKDEHWSKNKHGDDGMRMGNKNGVTSDDFRT

SEQ ID NO: 7843 - protein, 442 aa, Brassica rapa
PSTFMRLMNEVLRAFIGRFVVVYFDDILIYSKSLEEHLEHLRAVFIALRDARLFGNLGKCTFCTDRVSFLGYVVTPQGIEVDKAKIEAIESWPQPKTVTQVRSFLGLAGFYRRFVRDFRTIAATHNELTKKDVPFVWGTAQEEAFTVLKDKLTHAPLLQLPDFNKTFELECDASGIGLGGVLLQDGKPVAYFSEKLSGPSLNYSTYDKELYALVRTLETWQHYLWPKEFVIHSDHESLKHIKSQAKLNRRHAKWVEFIETFPYVIKHKKGKENVIADALSRRYTMLSQLDFKIFGLETIKDQYVHDADFKDVLQNCKEGRTWNKFVVNDGFVFRANKLCIPASSLRLLLLQEAHGGGLMGHFGVKKTEDVLATHFFWPKMRRDVERFVARCTTCQKAKSRLNPHGLYMLSFLATFGDVYGLSWGLNCFLVLLVTPKLMDKLK

SEQ ID NO: 7844 - protein, 143 aa, Secale cereale
MAAALSLRAPFSLRTVAPPAPRVALAPAALSLAAAKQVRGARLRAQATYKVKLVTPEGEVELEVPDDVYILDQAEEEGIDLPYSCRAGSCSSCAGKLVSGEIDQSDQSFLDDDQMEAGWVLTCHAYPKSDIVIETHKEEELTA

SEQ ID NO: 7845 - protein, 143 aa, Leymus cinereus x Leymus triticoides
MAAALSLRAPFSLRAVAPPAPRVALAPAALSLTAAKQVRGARLRAQATYKVKLVTPEGEVELEVPDDVYILDQAEEEGIDLPYSCRAGSCSSCAGKLVSGEIDQSDQSFLDDDQMEAGWVLTCHAYPKSDIVIETHKEEELTA

SEQ ID NO: 7846 - protein, 143 aa, Secale cereale
  misc_feature (42)..(42): Xaa can be any naturally occurring amino acid
MAAALSLRAPFSLRTVAPPAPRVALAPAALSLAAAKQVRGAXLRAQATYKVKLVTPEGEVELEVPDDVYILDQAEEEGIDLPYSCRAGSCSSCAGKLVSGEIDQSDQSFLDDDQMEAGWVLTCHAYPKSDIVIETHKEEELTA

SEQ ID NO: 7847 - protein, 144 aa, Avena sativa
MATALSSLRAPFSLRAAAPPAPRVALAPAALGLTAAKQVRGASLRAQATYKVKLITPEGEVELEVPDDVYILDQAEEEGIDLPYSCRAGSCSSCAGKLVSGSLDQSDQSFLDDEQMEAGWVLTCHAYPTSDLVIETHKEEELTA

SEQ ID NO: 7848 - protein, 144 aa, Festuca arundinacea
MATALSSLRAPFSLRAASPPAPRVALAPANLALAAAKQVRGARLRAQATYKVKLITPEGEVELEVPDDVYILDQAEEEGIDLPYSCRAGSCSSCAGKLVSGSLDQSDQSFLDDEQMEEGWVLTCHAYPTSDLVIETHKEEELTA

SEQ ID NO: 7849 - protein, 144 aa, Lolium multiflorum
MATALSSLRAPFSLRAAAPPAPRVALAPANLALTAAKQVRGARLRAQATYKVKLITPEGEVELEVPDDVYILDQAEEEGIDLPYSCRAGSCSSCAGKLVSGSLDQSDQSFLDDEQMEEGWVLTCHAYPTSDLVIETHKEEELTA

SEQ ID NO: 7850 - protein, 131 aa, Secale cereale
MASTGVKDFYRQKKKGGVGKTSASSKKKTQNYTGGASVGASNKAQTAALISHGSIDLKDDFSEQEEQLRQFDMDMKFGPCIGVNRLQRWERASAMGLQPPPHLRDLLARASSGNNRNNGGPSPECLWEGKI

SEQ ID NO: 7851 - protein, 131 aa, Secale cereale
MASTGVKDFYRQKKKGGVGKTSASSKKKTQNYTGGASVGASNKAQTAALISHGSLDLKDDFSEQEEQLRQFDMDMKFGPCIGVNRLQRWERASAMGLQPPPHLRDLLAGASSGNNRNNGSPSPECLWEGKI

SEQ ID NO: 7852 - protein, 131 aa, Secale cereale
MASTGVKDFYRQKKNGGVGKTSASSKKKTQNYTGGASVGASNKAQTAALISHGSIDLKDDFSEQEEQLRQFDMDMKFGPCIGVNRLQRWERASAMGLQPPPHLRDLLAGASSGNNRNNGGPSPECLWEGKI

SEQ ID NO: 7853 - protein, 131 aa, Hordeum vulgare
MASTGVKDFYRQKKKGGAGKTSASSKKKPQNYTGGASVGASNKAQTAALISHGSFDLKDDFSEQEEQLRQFDMDMKFGPCIGVNRLQRWERASAMGLQPPPHLRDLLARAASGNNRNNGGPSPECLWEGKI

SEQ ID NO: 7854 - protein, 131 aa, Pseudoroegneria spicata
MASTGVKDFYRQKKKGGAGKTSASSKKKTQNYTGGASVGASNKAQTAALISHGSIDLKDDFNEQEEQLRQFDMDMKFGPCIGVNRLQRWERASAMGLQPPPHLRDLLMCASSGNNRNNGGPSPECLWEGKI

SEQ ID NO: 7855 - protein, 177 aa, Avena sativa
MASTGVKDFYRQKKKGGVAKTSTSSKKKTQQYTGGASVGAGNPAQTAALISHGSLDLKDDFSEQEEQLRQFDLDMKFGPCIGVNRLQRWERASAMGLQPPPHLRDLLRGPHQLTIAIMALPPPSACGRAKSRTGFPLQQVIHPIASYPCCHHHHLRRVPLALLLSCWDPGSLVETLY

SEQ ID NO: 7856 - protein, 171 aa, Avena sativa
KDFYRQKKKGGVAKTSTSSKKKTQQYTGGASVGAGNPAQTAALISHGSLDLKDDFSEQEEQLRQFDLDMKFGPCIGVNRLQRWERASAMGLQPPPHLRDLLRGPHQLTIAIMALPPPSACGRAKSRTGFPLQQVIHPIASYPCCHHHHLRRVPLALLLSCWDPGSLVETLY

SEQ ID NO: 7857 - protein, 131 aa, Brachypodium distachyon
MASSGVKDFYRQKKKGGITKTSSCSKKKTQQYTGGASVGASNPAQTSALISHGSLDLKDDISEQEEQLRQFDMDMKFGPCIGVNRLQRWERASAMGLQPPSHLRDLLAHSASMNNHNNGSPSPECLWEGKI

SEQ ID NO: 7858 - protein, 59 aa, Secale cereale
  misc_feature (2)..(2): Xaa can be any naturally occurring amino acid
  misc_feature (6)..(6): Xaa can be any naturally occurring amino acid
  misc_feature (8)..(8): Xaa can be any naturally occurring amino acid
  misc_feature (11)..(11): Xaa can be any naturally occurring amino acid
  misc_feature (13)..(13): Xaa can be any naturally occurring amino acid
  misc_feature (17)..(17): Xaa can be any naturally occurring amino acid
  misc_feature (25)..(25): Xaa can be any naturally occurring amino acid
  misc_feature (29)..(29): Xaa can be any naturally occurring amino acid
  misc_feature (31)..(32): Xaa can be any naturally occurring amino acid
  misc_feature (38)..(38): Xaa can be any naturally occurring amino acid
  misc_feature (47)..(47): Xaa can be any naturally occurring amino acid
  misc_feature (57)..(57): Xaa can be any naturally occurring amino acid
MXMKFXPXIGXNXLQRXERASAMGXQPPXHXXNILAGXSPGNNRNNXSPSPECLWEXKI

SEQ ID NO: 7859 - protein, 131 aa, Cynodon dactylon
MASSGVKDFYRQKKKGSVSKESTSSKKKTQQYTGGASVGALDTAQTSALVSHGSWDLKEDFGDQEEQLRQFDMDMKFGPCIGVTRLQRWERASAMGLQPPPHIQDLLLRASSTKNRSSSGPSPECLWEGKV

SEQ ID NO: 7860 - protein, 131 aa, Oryza sativa
MASGGMKDFYRQKKKGGPTKASSSSKKKTQHYTGGASVGASDTAQTSALISHGNLDLKDDFSEQEEQLRLFDMDMKFGPCIGVTRLQRWERASAMGLHPPPHLRDLLLNNTHAGNHNNNGPSLECLWEGKV

SEQ ID NO: 7861 - protein, 440 aa, Secale cereale
MSPVRIIDASYVRVPETAAPPPGPIRFTAMEALWVVFPVLQHVLLYQGDDMPPFDAILQSLRSSLAATLESFAPLAGKLVHLEDTGDVGISCSASDGVRFVVAECDADIRRLAGDEEHDLRVLEALVPEVDMGQLPTAVLAVQATRFAGGVALGLTVHHGAADGRALWTFVEAWATACRGEAPAATPCFDRSLVKMPAGDELASSVLRKFAPNLPSAALASSVFDDRKRLTRRTFTLDEGDIKRLKQHIVHLNESGGTPLPRPPSGFATVVALAWTCFARCKSFSLDDDLWLFFFADIRERLDPPVGAGYIGSCLTKCLARLPARELHGERALAAAASAVQDEINKMKEDPIAGWNFFSYDVMPIMDRLMNISGSSGFSAYKIADFGWGKPRRTEPIRMNTDGQVALMGSRDGRGVQVSVALLQAAQMDEFKSNFLALLE

SEQ ID NO: 7862 - protein, 441 aa, Secale cereale
MSQVRIVDASYVDVPETAVRPPGPIKLTAMEALWIIIPVLQHVLLYEGDDDMPPFDAIVQSLRSSLAATLGSAPPLAGKLVHLEETGDVGISCSASDGVRFVVAECGADIGRLAGDEEHDLRVLEGLVPEVDMSQLPAPVLAVQATRFEGGVAVGVTVHHGVADGRALWTFVEAWAAACRGETPATTPCFDRSLVKLPGGEELARSVVRKVAPNLPSVAPPSSLVEDRKRFSRRTFTLETQDIQRLKQRIVHLAESCGAPLLHTPSTFTAVVALAWTCFARSKPFSSKDDAQLFFFADTRERLDPPVDAGYIGACLAGSLSKLPVPVLRGDHALAAAASTVQDEINKLKEDPIAGWNFYTLIADACIDRMMNISGSSGFRAYEVGDFGWGKPSRTESITMNHDGQVALMRSRDGQGVQVSVSLLQPAQMDAFKSSFLELLK

SEQ ID NO: 7863 - protein, 347 aa, Triticum aestivum
MGSNDPSTPPKASKPPEQEQPPATTSGTTAPVYPEWPGFQGYPAMPPHGFFPPPVAAGQAHPYMWGAQHMVPPYGTPPPPYMMYPPGTVYAHPTTPGVHPFHYPMQTNGNLEPAGAQGAAPGAAETNGKNEPGKTSGPSANGVTSNSESGSDSESEGSDANSQNDSHSKENDVNENGSAQNGVSHSSSHGTFNKPMPLVPVQSGAVIGGVAGPATNLNIGMDYWGATGSSPVPAMRGKAPSGSARGEQWDERELKKQKRKLSNRESARRSRLRKQAECEELGQRAEALKSENSSLRIELDRIKKEYEELLSKNTSLKAKLGETGGGDSVPDMNERGDTNGGSHHKEP

SEQ ID NO: 7864 - protein, 347 aa, Secale cereale
MGSNDPSTPPKASKPPEQEQPPATTSGTTAPVYPEWPGFQGYPAMPPHGFFPPPVAAGQAHPYMWGAQHMVPPYGTPPPPYMMYPPGTVYAHPTTPGVHPFHYPMQTNGNLEPAGAQGAAPGAAETNGKNEPGKTSGPSANGVTSNSESGSDSESEGSDANSQNDSHSKENDVNENVQSGAVIGGVAGPATNLNIGMDYWGATGSSPVPAMRGKVPSGSARGEQWDERELKKQKRKLSNRESARRSRLRKQAECEELGQRAEALEVGELVPQDRARPDQKGVRGAPFEEHLSQGQARGDRRRRRLGPRHERTGRRQRRQPPEGALTDRRRRMRHLLFYLLTHIARDD

SEQ ID NO: 7865 - protein, 223 aa, Secale cereale
MGSNDPSTPPKASKPPEQEQPPATTSGTTAPVYPEWPGFQGYPAMPPHGFFPPPVAAGQAHPYMWGAQHMVPPYGTPPPPYMMYPPGTVYAHPTTPGVHPFHYPMQTNGNLEPAGAAPGAAETNGKNEPGKTSGPSANGVTSNSESGSDSESEGSDANSQNDSHSKENDVNENVQSGAVIGGVAGPATNLNIGMDYWGATGSSPVPAMRGKRPSGSARGEQVG

SEQ ID NO: 7866 - protein, 343 aa, Brachypodium distachyon
MGSNDPSTPSKPSKVPEQEQPPATTSGTTAPVYPEWPGFQGYPAMPPHGFFPPPVAAGQAHPYMWGAQHMVPPYGTPPPPYMMYPPGTVYAHPSTPGVHPFHYPVPTNGNLDPAGAAPGASEINGKNEPGKTSGPSANGITSNSESGSDSESEGSDANSQNDSHSKENDVNENGSSQNGVSHSSSNGIFNKTMPLVPVQSGAVIGGVAGPATNLNIGMDYWGATGSSPLPAMRGKVPSGSVRGEQWDERELKKQKRKLSNRESARRSRLRKQAECEELGQRAEVLKSENSSLRAELERVKKEYEELRLKNASLKEKLGEAGDSVPDMNEQSDTNGGSHQQKEA

SEQ ID NO: 7867 - protein, 316 aa, Leymus cinereus x Leymus triticoides
MSSKKIELDHKDMVHDSAIDYYGKRLATASSDSTVKITNIGGASAPSQLVATLTGHYGPVWRVGWAHPKYGSILASCGYDGRVIVWKEGATGQWSQLHVFDNHKASVNSIAWAPYELGLCLACGSSDGTISVISMRLDAGGWDAATIERAHPVGVTAVSWAPAAALGSMVGSDQLVHKLVSGGFDCVVKVWEFVNGGWKLESALVSDMHKECVRDVSWAPVLGLAKSTIASASQDGKVVIWTSGKAGGKWEGKLMRDFEAPVWRVSWSLTGNILSVAAGEGDITLWKESSDGQWESLWTKASDEPPQEQAIEEAMQ

SEQ ID NO: 7868 - protein, 317 aa, Triticum aestivum
MSSKKIELDHKDMVHDSAIDYYGKRLATASSDSTVKITNIGGASAPSQLVATLTGHYGPVWRVGWAHPKYGSILASCGYDGRVIVWKEAATGQWSQLHVFDNHKASVNSIAWAPYELGLCLACGSSDGTISVISMRLDTGGCDAATIERAHPVGVTAVSWAPAAALGSMVGSDQLVHKIVSGGFDCVVKVWEFVNGGWKLESALVSDMHKECVRDVSWAPVLGLAKSTIASASQDGKVVIWTSGKGGGKWEGKLMRDFEAPVWRVSWSLTGNILSVAAGEGDITLWKESSDGQWESLWTKASEEPPQEEQAIEEAMQ

SEQ ID NO: 7869 - protein, 317 aa, Triticum aestivum
MSSKKIELDHKDMVHDSAIDYYGKRLATASSDSTVKITNIGGASAPSQLVATLTGHYGPVWRVGWAHPKYGSILASCGYDGRVIVWKEAATGQWSQLHVFDNHKASVNSIAWAPYELGLCLACGSSDGTISVISMRLDTGGCEAATIERAHPVGVTAVSWAPAAALGSMVGSDQLVHKIVSGGFDCVVKVWEFVNGGWKLESALVSDMHKECVRDVSWAPVLGLAKSTIASASQDGKVVIWTSGKGGGKWEGKLMRDFEAPVWRVSWSLTGNILSVAAGEGDITLWKESSDGQWESLWTKASEEPPQEEQAIEEAMQ

SEQ ID NO: 7870 - protein, 318 aa, Secale cereale
MSSKKIELDHKDMVHDSAIDYYGKRLATASSDSTVKITNIGGASAPSQLVATLTGHYGPVWRVGWAHPKYGSILASCGYDGRVIVWKEGATGQWSQLHVFDNHKASVNSIAWAPYELGLCLACGSSDGTISVISMRTDTGGWDAATIERAHPVGVTAVSWAPAAALGAMVGSDQLVHKLVSGGFDCVVKVWEFVNGGWKLESALVSDMHKECVRDVSWAPVLGLAKSTIASASQDGKVVIWTSGKGGGKWEGKLMRDFEAPVWRVSWSLTGNILSVAAGEGDITLWKESSDGQWESLWTKASEEPPQEQEQAIEEAMQ

SEQ ID NO: 7871 - protein, 317 aa, Triticum aestivum
MSSKKIELDHNDMVHDSAIDYYGKRLATASSDSTVKITSIGGASAPSQLVATLTGHYGPVWRVGWAHPKYGSILASCGYDGRVIVWKEAATGQWSQLHVFDNHKASVNSIAWAPYELGLCLACGSSDGTISVISMRPDTGGCDAATIERAHPVGVTAVSWAPAAALGSMVGSDQLVHKIVSGGFDCVVKVWEFVNGGWKLESALVSDMHKECVRDVSWAPVLGLAKSTIASASQDGKVVIWTSGKGGGKWEGKLMRDFEAPVWRVSWSLTGNILSVAAGEGDITLWKESSDGQWESLWTKASEEPPQEEQAIEEAMQ

SEQ ID NO: 7872 - protein, 318 aa, Secale cereale
MSSKKIELDHKDMVHDSAIDYYGKRLATASSDSTVKITNIGGASAPSQLVATLTGHYGPVWRVGWAHPKYGSILASCGYDGRVIVWKEGAAGQWSQLHVFDNHKASVNSIAWAPYELGLCLACGSSDGTISVISMRTDTGGWDAATIERAHPVGVTAVSWAPAAALGAMVGSDQLVHKLVSGGFDCVVKVWEFVNGGWKLESALVSDMHKECVRDVSWAPVLGLAKSTIASASQDGKVVIWTSGKGGGKWEGKLMRDFEAPVWRVSWSLTGNILSVAAGEGDITLWKESSDGQWESLWTKASEEPQQEQEQAIEEAMQ

SEQ ID NO: 7873 - protein, 317 aa, Pseudoroegneria spicata
  misc_feature (289)..(289): Xaa can be any naturally occurring amino acid
  misc_feature (311)..(311): Xaa can be any naturally occurring amino acid
MSSKKIELDHKDMVHDSAIDYYGKRLATASSDSTVKITNIGGASAPSQLVATLTGHYGPVWRVGWAHPKYGSILASCGYDGRVIVWKEGATGQWSQLHVFDNHKASVNSIAWAPYELGLCLACGSSDGTISVISMRHDTGGWDAAIIERAHPVGVTAVSWAPAAALGSMVGSDQLVHKLVSGGFDCVVKVWEFVNGGWKLESALVSDMHKECVRDVSWAPVLGLAKSTIASASQDGKVVIWTSGKGGGKWEGKLMRDFEAPVWRVSWSLTGNILSVAAGEGDITLWKEXSDGQWESLWTKASEEPPQEEQXIEEAMQ

SEQ ID NO: 7874 - protein, 319 aa, Avena sativa
MSSKKIELDHKDMVHDSAIDYYGKRLATASSDSTVKITSIGGASAPSQLVATLTGHYGPVWRVGWAHPKYGSILASCGYDGRVIVWKEGAAGQWSQAHVFDNHKSSVNSIAWAPYELGLSLACASSDGTISVMSMRSDGGWDSATIERAHPVGVTAVSWAPAAALGSMVGSDQLVHKLVSGGFDSVVKVWEFVNGGWKLESALVSDMHTECVRDVSWAPVLGLAKSTIASASQDGKVVIWTNGKGGGDKWEGKVMRDFEAPVWRVSWSLTGDMLSVAAGEGDITLWKEASDGQWESLWTKGSDEPQEQATEEATEEAAQ

SEQ ID NO: 7875 - protein, 316 aa, Brachypodium distachyon
MSSKKIELDHKDMVHDSAIDYYGKRLATASSDSTVKIVNIGGASAPSQLLATLTGHYGPVWRVGWAHPKYGSILASCSYDGRVIVWKEGATGQWSQAHVFSNHKSSVNSIAWAPYELGLCLACGSSDGSISVMSMQPDGGWDTATIERAHPVGVTAVSWAPATALGSMVGSDQLVHKLVSGGFDCVVKVWEFVNGGWKVESALVSDMHAECVRDVSWAPVLGLAKSTIASASQDGKVVIWTKGKGGDKWEGKMMRDLEAPVWRVSWSLTGNILSVAAGEGAITLWKETSDGQWEQLWTKASGEPQEQATEEVIAAQ

SEQ ID NO: 7876 - protein, 260 aa, Hordeum vulgare
MAATTAASLPRLSLPPPAALPAVTSSRFRPDLASVPSRRRVGLRLHRSPVAPAAAASSPSAPSSSPEPGSGIGDALGGVAIFSAATGEPVLIRDLWDQNEGMAVVALLRHFGCPCCWELALTLKDAKERFDSAGVKLIAVGVGTPDKARILAERLPFPLDYLYADPERKAYDLLGLYFGVGRTFFNPASVKVFSRFDSLKEATKNYTIEATPDDRPSVLQQGGMFVFKGKELLYARKDEGTGDHAPLDDVLNICCKVPVA

SEQ ID NO: 7877 - protein, 256 aa, Secale cereale
MAASLPRLSLPPTAALPAVTSSRYRPDLAPVPNRRRLGLRLHRSPVVPAAAASSPSVPSSSPEPGSGIGDALGGVAIFSAATGEPVLIRDLWDQNEGMAVVALLRHFGCPCCWELALTLKAAKERFDSAGVKLIAVGVGTPDKARILAERLPFPLDYLYADPERKAYDLLGLYFGVGRTFFNPASVKVFSRFDSLKEATKNYTIEATPDDRPSVLQQGGMFVFKGKELLYARKDEGTGDHAPLDDVLNICCKVPVA

SEQ ID NO: 7878 - protein, 257 aa, Triticum aestivum
MAASLPRLSLPPTAALPAVASSRYRPDLAPVPSRRRRLGLRLHRSPLAPAAAASSPSIPSSSPEPGSGIGDALGGVAIFSAATGEPVLIRDLWDQNEGMAVVALLRHFGCPCCWELALTLKDAKERFDSAGVKLIAVGVGTPDKARILAERLPFPLDYLYADPERKAYDLLGLYFGVGRTFFNPASVKVFSRFDSLKEATKNYTIEATPDDRPSVLQQGGMFVFKGKELLYARKDEGTGDHAPLDDVLNICCKVPVA

SEQ ID NO: 7879 - protein, 282 aa, Avena sativa
LLGIRGLSLPPGQGFAASPPSHGRDYGRLAPTPLPPAAGHSFYRHLLSLPSQPRLCPHAAAPSSLRLHRSLVVPPNAASSPSVASSSPEPGSGIGDALGGVAIFSAATGEPVLIKDLWDQNEGMAVVALLRHFGCPCCWELALALKETKERFDAAGVKLIAVGVGTPDKARILAERLPFPLDYLYADPERKAYDLLGLYFGLGRTFFNPASVKVFSRFDSLKEATKNYTIEATPDDRPSVLQQGGMFVFKGKELLYARKDEGTGDHAPLDDVLNICCKVPVA

SEQ ID NO: 7880 - protein, 284 aa, Avena sativa
FRLLGIRGLSLPPGQGFAASPPSHGRDYGRLAPTPLPPAAGHSFYRHLLSLPSQPRLCPHAAAPSSLRLHRSLVVPPNAASSPSVASSSPEPGSGIGDALGGVAIFSAATGEPVLIKDLWDQNEGMAVVALLRHFGCPCCWELALALKETKERFDAAGVKLIAVGVGTPDKARILAERLPFPLDYLYADPERKAYDLLGLYFGLGRTFFNPASVKVFSRFDSLKEATKNYTIEATPDDRPSVLQQGGMFVFKGKELLYARKDEGTGDHAPLDDVLNICCKVPVA

SEQ ID NO: 7881 - protein, 150 aa, Saccharum officinarum
MGNALPLTDMPLGTAIHNIEITRGRGGQLARAAGAVAKLIAKEGKLATLRLPSGEVRLVSQNCLATVGQVGNVGVNQKSLGRAGSKCWLGKRPVVRGVVMNPVDHPHGGGEGKAPIGRKKPTTPWGYPALGRRTRKRKKYSDSFILRRRK

SEQ ID NO: 7882 - protein, 271 aa, Sorghum bicolor
TAKHLYKTPIPSTRKGTVDRQVKSNPRNKLIHGRHRCGKGRNARGIITARHRGGGHKRLYRKIDFRRNQKDISGRIVTIEYDPNRNAYICLIHYGDGEKRYILHPRGAIIGDTIVSGTKVPISMGNALTDMPLGTAIHNIEITRGRGGQLARAAGAVAKLIAKEGKLATLRLPSGEVRLVSQNCLATVGQVGNVGVNQKSLGRAGSKCWLGKRPVVRGVVMNPVDHPHGGGEGKAPIGRKKPTTPWGYPALGRRTRKRKKYSDSFILRRRK

SEQ ID NO: 7883 - protein, 141 aa, Zea mays
MPLGTAIHNIEITHGRGGQLARAAGAVAKLIAKEGKLATLRLPSGEVRLVSQNCLATVGQVGNVGVNQKSLGRAGSKCWLGKRPIVRGVVMNPVDHPHGGGEGKAPIGRKKPTTPWGYPALGRRTRKRKKYSDSFILRRRK

SEQ ID NO: 7884 - protein, 140 aa, Lolium multiflorum
MAKHLYKTPIPSTRKGTVDRQVKSNPRNNLIHGRHRCGKGRNSRGIITARHRGGGHKRLYRKIDFRRNQKDISGRIVTIEYDPNRNAYICLIHYGDGEKRYILHPRGAIIGDTIVSGTKVPISMGNAPTFDRYALRHGHA

SEQ ID NO: 7885 - protein, 273 aa, Unknown
  Sequence found in Organisms: Hordeum vulgare, Triticum aestivum
MAKHLYKTPIPSTRKGTVDRQVKSNPRNNLIHGRHRCGKGRNSRGIITARHRGGGHKRLYRKIDFRRNQKDISGRIVTIEYDPNRNAYICLIHYGDGEKRYILHPRGAIIGDTIVSGTKVPISMGNALPLTDMPLGTAMHNIEITRGRGGQLARAAGAVAKLIAKEGKSATLRLPSGEVRLVSQNCLATVGQVGNVGVNQKSLGRAGSKCWLGKRPVVRGVVMNPVDHPHGGGEGKAPIGRKKPTTPWGYPALGRRTRKRKKYSDSFILRRRK

SEQ ID NO: 7886 - protein, 150 aa, Brachypodium distachyon
MGNALPLTDMPLGTAMHNIEITRGRGGQLARAAGAVAKLIAKEGKSATLRLPSGEVRLVSQNCLATVGQVGNVGVNQKSLGRAGSKCWLGKRPIVRGVVMNPVDHPHGGGEGKAPIGRKKPTTPWGYPALGRRTRKRKKYSDSFILRRRK

SEQ ID NO: 7887 - protein, 273 aa, Oryza sativa
MAKHLYKTPIPSTRKGTIDRQVKSNPRNNLIHGRHRCGKGRNSRGIITARHRGGGHKRLYRKIDFRRNQKDISGRIVTIEYDPNRNAYICLIHYGDGEKGYILHPRGAIIGDTIVSGTKVPISMGNALPLTDMPLGTAIHNIEITRGRGGQLARAAGAVAKLIAKEGKSATLRLPSGEVRLVSQNCLATVGQVGNVGVNQKSLGRAGSKCWLGKRPVVRGVVMNPVDHPHGGGEGKAPIGRKKPTTPWGYPALGRRTRKRKKYSDSFILRRRK

SEQ ID NO: 7888 - protein, 273 aa, Oryza sativa
TAKHLYKTPIPSTRKGTIDRQVKSNPRNNLIHGRHRCGKGRNSRGIITARHRGGGHKRLYRKIDFRRNQKDISGRIVTIEYDPNRNAYICLIHYGDGEKGYILHPRGAIIGDTIVYGTKVPISMGNALPLTDMPLGTAIHNIEITRGRGGQLARAAGAVAKLIAKEGKSATLRLPSGEVRLVSQNCLATVGQVGNVGVNQKSLGRAGSKCWLGKRPVVRGVVMNPVDHPHGGGEGKAPIGRKKPTTPWGYPALGRRTRKRKKYSDSFILRRRK

SEQ ID NO: 7889 - protein, 140 aa, Oryza sativa
TTKHLYKTPIPSTRKGTIDRQVKSNPRNNLIHGRHRCGKGHNSRGIITARHRGGGHKRLYRKIDFRRNQKDISGRIVTIEYDPNRNAYICLIHYGDGEKGYILHPRGAIIGDTIVSGTKVPISMGNALPLNRYALRHGHT

SEQ ID NO: 7890 - protein, 277 aa, Sorghum bicolor
RRILNNTAKHLYKTPIPSTRKGTVDRQVKSNPRNKLIHGRHRCGKGRNARGIITARHRGGGHKRLYRKIDFRRNQKDISGRIVTIEYDPNRNAYICLIHYGDGEKRYILHPRGAIIGDTIVSGTKVPISMGNALTDMPLGTAIHNIEITRGRGGQLARAAGAVAKLIAKEGKLATLRLPSGEVRLVSQNCLATVGQVGNVGVNQKSLGRAGSKCWLGKRPVVRGVVMNPVDHPHGGGEGKAPIGRKKPTTPWGYPALGRRTRKRKKYSDSFILRRRK

SEQ ID NO: 7891 - protein, 1090 aa, Zea mays
MRDARAPQFQRRGQGGVGVVLLPLMLLLAGTASGQQQIQPPPVPPADLPDVERRLNNLTDHVATTISDKFRFCVADPKEDWNEAFNYTSDLSFVDRCLTETQGDLPQRLCGPDEVKFYFSSLYDRDGDKNINLKTNINCNMSSWGKGCDAGWACATDPVPDRPSNRGSNDIPLRTSSCQACCEGFFCPRGLTCMLPCPLGSYCPRATANHTTGLCDPYKYQIAPNSTDSCGGADMWADIQSTEEIFCPAGYYCPSTTRKDNCSSGHYCRLGSTAEEKCIIKASCEENAENEHIAILGACIVGALCLLLLVIYNCSDKFLSIRERRKARSRENAIRLARQQLKAQEGWKAAKQFARRHVSGMQGHLSRTFSRRRSFRQQVDADKSSHRVQEAPLMGQVQMQEMSDSAVFASESANEITEAMPSVIVDVSDGEVVATNENPAPKGKHRSTHTQVFKYAYGEIEKEKFQQRQDNKNLTFTGVIAMVKDQQKEITRPLLKVEFRDLTLMLGKKKLLRSINGELRPGRVTAVMGPSGAGKTTFLNAVTGKVNGYKMTGSVLVNGKNLNIRSYKKVIGFVPQDDIVHGNLTVEENLWFSAKCRLSASMKHRDKVLLVERVIDSLDLQGIRNSLVGTVEKRGISGGQRKRVNVGIEMVMEPSLLILDEPTSGLDSSSSQLLLRALRHEALQGVNVCAVVHQPSYTLYNMFDDLILLAKGGLMVYNGPVKTVEEYFTALGIHVPDRVNPPDHYIDILEGIVKPDSSAIKAKHLPVHWMLHNGYEVPSDMQDDVKEIGEQAPQFRSSSSTSGSPSPHCLPIRNAFAEERDRLEQRLSKPKDLSSRKTPGIFMQYKYYLGRVTKQRLREARLLMVDFLILGLAGICLGTIAKLSDKTFGMPGYIYTIIAVSLLCKIAALRSFSLERLQYFRERESGMSSLAYFLARDTIDHFSTVVKPIIYLSMFYYFNNPRSTIADNYIVLLALVYCVTGIGYTFAICFSPGSAQLCSALIPVVLTLLSTQKSTPTLIRRLCYSKWALEGFIIVNAKKYPGVWLITRCGLLFQSQFDIHNYKLCILILFMYGLFFRMVAFAAMILLKKR

SEQ ID NO: 7892 - protein, 278 aa, Brachypodium distachyon
RILNNTAKHLYKTPISSTRKGTVDRQVKSNPRNNLIHGRHRCGKGRNSRGIITARHRGGGHKRLYRKIDFRRNQKDISGRIVTIEYDPNRNAYICLIHYGDGEKRYILHPRGAIIGDTIVSGTKVPISMGNALPLTDMPLGTAMHNIEITRGRGGQLARAAGAVAKLIAKEGKSATLRLPSGEVRLVSQNCLATVGQVGNVGVNQKSLGRAGSKCWLGKRPIVRGVVMNPVDHPHGGGEGKAPIGRKKPTTPWGYPALGRRTRKRKKYSDSFILRRRK

SEQ ID NO: 7893 - protein, 159 aa, Brachypodium distachyon
MGNALPLSARKEESTSTDMPLGTAMHNIEITRGRGGQLARAAGAVAKLIAKEGKSATLRLPSGEVRLVSQNCLATVGQVGNVGVNQKSLGRAGSKCWLGKRPIVRGVVMNPVDHPHGGGEGKAPIGRKKPTTPWGYPALGRRTRKRKKYSDSFILRRRK

SEQ ID NO: 7894 - protein, 137 aa, Pseudoroegneria spicata
MGNALPLTDMPLGTAMHNIEITRGRGGQLARAAGAVAKLIAKEGKSATLRLPSGEVRLVSQNCLATVGQVGNVGVNQKSLGRAGSKCWLGKRPVVRGVVMNPVDHPHGGGEGKAPIGRKKPTTPWGYPALGRRTRKR

SEQ ID NO: 7895 - protein, 286 aa, Oryza sativa
ILNNTAKHLYKTPIPSTRKGTIDRQVKSNPRNNLIHGRHRCGKGRNSRGIITARHRGGGHKRLYRKIDFRRNQKDISGRIVTIEYDPNRNAYICLIHYGDGEKGYILHPRGAIIGDTIVYGTKVPISMGNALPLSARKEESTSTDMPLGTAIHNIEITRGRGGQLARAAGAVAKLIAKEGKSATLRLPSGEVRLVSQNCLATVGQVGNVGVNQKSLGRAGSKCWLGKRPVVRGVVMNPVDHPHGGGEGKAPIGRKKPTTPWGYPALGRRTRKRKKYSDSFILRRRK

SEQ ID NO: 7896 - protein, 286 aa, Brachypodium distachyon
ILNNTAKHLYKTPISSTRKGTVDRQVKSNPRNNLIHGRHRCGKGRNSRGIITARHRGGGHKRLYRKIDFRRNQKDISGRIVTIEYDPNRNAYICLIHYGDGEKRYILHPRGAIIGDTTVSGTKVPISMGNALPLSARKEESTSTDMPLGTAMHNIEITRGRGGQLARAAGAVAKLIAKEGKSATLRLPSGEVRLVSQNCLATVGQVGNVGVNQKSLGRAGSKCWLGKRPIVRGVVMNPVDHPHGGGEGKAPIGRKKPTTPWGYPALGRRTRKRKKYSDSFILRRRK

SEQ ID NO: 7897 - protein, 282 aa, Oryza sativa
MTKHLYKTPIPSTCKGTIDRQVKSNPRNNLIHGRHRCGKGRNSRGIITARHRGGGHKRLYRKIDFRRNQKDISGRIVTIEYDPNRNAYICLIHYGDGEKGYILHPRGAIIGDTIVSGTKVPISMGNALPLSARKEESTSTDMPLGTAIHNIEITRRRGGQLARAAGAVAKLIAKDGKSATLRLLSGEVRLVSQNCLATVGQVGNVGVNQKSLGRAGSKCWLGKRPVVRGVVMNPVDHPHGGGEGKAPIGRKKPTTPWGYPALGRRTRKRKKYSDSFILRRRK

SEQ ID NO: 7898 - protein, 149 aa, Elaeis guineensis
MGNALPLTDMPLGTAIHNIEITLGKGGQLARAAGAVAKLIAKEGKSATLRLPSGEVRLISKNCLATVGQVGNVGVNQKSLGRAGSKCWLGKRPVVRGVVMNPVDHPHGGGEGRAPIGRKNPQPLGYPALGRRSRKRKKYSDSFILRRRK

SEQ ID NO: 7899 - protein, 339 aa, Amorphophallus konjac
MVREEIAGSTRTLQWKCVESRIDSKRLYYGRFVLSPLMKGQADTMGIAMRRILLEEIEGTCITRAKSEKVPHEYSTIVGIEESIHEILMNLKEIVLRSNLYGIRDASICVKGPRYITAQDIILPPSVEIVDTTQHIATLTEPLDLCIGLQIQRDRGYRMRPTNNSQDGSYPIDAVSMPVQNANHSIYSYGNGNEKQEILFLEIWTNGSLTPKEALHEASRNLIDLFIPFLHAEEKDINFEENKSRFTLPPFTFHDRLANLKKNKKEIALKCIFIDQSELPSRTYNCLKRSNIHTLLDLLSNSQEDLMKIEYLRIEDVKRIVDILQKHFTINLPKTKFSF

SEQ ID NO: 7900 - protein, 272 aa, Elaeis guineensis
MAIHLYKTSTPSTRNGAVDSQVKSNPRNNLIYGQHRCGKGRNARGIITARHRGGGHKRLYRKIDFRRNEKDISGRIVTIEYDPNRNAYICLIHYGDGEKRYILHPRGAIIGDTIVSGTEVPISMGNALPLTDMPLGTAIHNIEITLGKGGQLARAAGAVAKLIAKEGKSATLRLPSGEVRLISKNCLATVGQVGNVGVNQKSLGRAGSKCWLGKRPVVRGVVMNPVDHPHGGGEGRAPIGRKNPQPLGYPALGRRSRKRKNNSDSFILRRRK

SEQ ID NO: 7901 - protein, 286 aa, Oryza sativa
YIYIYIYIYIYIYIPSTRKGTIDRQVKSNPRNNLIHGRHRCGKGRNSRGIITARHRGGGHKRLYRKIDFRRNQKDISGRIVTIEYDPNRNAYICLIHYGDGEKGYILHPRGAIIGDTIVSGTKVPISMGNALPLSARKEESTSTDMPLGTAIHNIEITRGRGGQLARAAGAVAKLIAKEGKSATLRLPSGEVRLVSQNCLATVGQVGNVGVNQKSLGRAGSKCWLGKRPVVREVVMNPVDHPHGGGEGKAPIGRKKPTTPWGYPALGRRTRKRKKYSDSFILRRRK

SEQ ID NO: 7902 - protein, 329 aa, Arabidopsis thaliana
MVREKVKVSTRTLQWKCVESKRDSKRLYYGRFILSPLMKGQADTIGIAMRRALLGEIEGTCITRAKFENIPHDYSNIAGIQESVHEILMNLNEIVLRSNLYGTRNALICVQGPGYITARDIILPPAVEIIDNTQHIATLTEPIDLCIELKIERNRGYSLKMSNNFEDRSYPIDAVFMPVENANHSIHSYGNGNEKQEILFLEIWTNGSLTPKEALHQASRNLINLFIPFLHVEEETFYLENNQHQVTLPFFPFHNRLVNLRKKKKTKELAFQYIFIDQLELPPRIYNCLKKSNIHTLLDLLNNSQEDLIKIEHFHVEDVKKILDILEKK

SEQ ID NO: 7903 - protein, 51 aa, Musa acuminata
MNPVDHPHGGGEGRAPIGRKKPTTPWGYPALGRRSRKRKKYSDSFILRRRK

SEQ ID NO: 7904 - protein, 274 aa, Gossypium raimondii
MAIHLYKTSTPGTRNGAVDSQVKSNPRNNLIYGQHRCGKGRNARGIITARHRGGGHKRLYRKIDFRRNEKDIYGRIVTIEYDPNRNAYICLIHYGDGEKRYILHPRGAIIGDTIVSGTEVPIKMGNALPLTDMPLGTAIHNIEITLGRGGQLARAAGAVAKLIAKEGKSATLKLPSGEVRLISKNCSATVGQVGNVGVNQKSLGRAGSKCWLGKRPVVRGVVMNPVDHPHGGGEGRAPIGRKKPATPWGYPALGRRSRKRNKYSDNLILRRRSK

SEQ ID NO: 7905 - protein, 274 aa, Petunia hybrida
MAIHLYKTSTPSTRNGTVDSQVKSNPRNNLIYGQHRCGKGRNSRGIITARHRGGGHKRLYRKIDFRRNEKDIYGRIVTIEYDPNRNAYICLIHYGDGEKRYILHPRGAIIGDTIVSGTEVPIKMGNALPLTDMPLGTAIHNIEITLGKGGQLARAAGAVAKLIAKEGKSATLKLPSGEVRLISKNCSATVGQVGNVGVNQKSLGRAGSKRWLGKRPVVRGVVMNPVDHPHGGGEGRAPIGRKKPTTPWGYPALGRRSRKRNKYSDNLILRRRSK

SEQ ID NO: 7906 - protein, 274 aa, Unknown
  Sequence found in Organisms: Solanum tuberosum, Solanum phureja
MAIHLYKTSTPSTRNGTVDSQVKSNPRNNLIYGQRRCGKGRNARGIITARHRGGGHKRLYRKIDFRRNEKDIYGRIVTIEYDPNRNAYICLIHYGDGEKRYILHPRGAIIGDTIVSGTEVPIKMGNALPLTDMPLGTAIHNIEITLGKGGQLARAAGAVAKLIAKEGKSATLKLPSGEVRLISKNCSATVGQVGNVGVNQKSLGRAGSKRWLGKRPVVRGVVMNPVDHPHGGGEGRAPIGRKKPTTPWGYPALGRRSRKRNKYSDNLILRRRSK

SEQ ID NO: 7907 - protein, 274 aa, Nicotiana tabacum
MAIHLYKTSTPSTRNGTVDSQVKSNPRNNLIYGQHHCGKGRNARGIITARHRGGGHKRLYRKIDFRRNEKDIYGRIVTIEYDPNRNAYICLIHYGDGEKRYILHPRGAIIGDTIVSGTEVPIKMGNALPLTDMPLGTAIHNIEITLGKGGQLARAAGAVAKLIAKEGKSATLKLPSGEVRLISKNCSATVGQVGNVGVNQKSLGRAGSKRWLGKRPVVRGVVMNPVDHPHGGGEGRAPIGRKKPTTPWGYPALGRRSRKRNKYSDNLILRRRSK

SEQ ID NO: 7908 - protein, 143 aa, Papaver somniferum
MGNALPLTDMPLGTAIHNIEITLGKGGQLARAAGAVAKLIAKEGKSATLKLPSGEVRLISKNCSATVGQVGNVGVNQKSLGRAGSKRWLGKRPVVRGVVMNPVDHPHGGGEGRAPIGRKQPTTPWGYPALGRRSRKGINIVIV

SEQ ID NO: 7909 - protein, 274 aa, Catharanthus roseus
MAIHLYKTSTPSTRNGTVDSQVKSNPRNNLIYGQHRCGKGRNARGIITAGHRGGGHKRLYRKIDFRRNEKDIYGRIVTIEYDPNRNAYICLIHYGDGEKRYILHPRGAIIGDTIVSGTEVPIKMGNALPLTDMPLGTAIHNIEITLGKGGQLARAAGAVAKLIAKEGKSATLKLPSGEVRLISKNCSATVGQVGNVGVNQKSLGRAGSKRWLGKRPVVRGVVMNPVDHPHGGGEGRAPIGRKKPTTPWGYPALGKRSRKRNKYSDNLILRRRSK

SEQ ID NO: 7910 - protein, 274 aa, Solanum melongena
MAIHLYKTSTPSTRNETVDSQVKSNPRNNLIYGQRRCGKGRNARGIITARHRGGGHKRLYRKIDFRRNEKDIYGRIVTIEYDPNRNAYICLIHYGDGEKRYILHPRGAIIGDTIVSGTEVPIKMGNALPLTDMPLGTAIHNIEITLGKGGQLARAAGAVAKLIAKEGKSATLKLPSGEVRLISKNCSATVGQVGNVGVNQKSLGRAGSKRWLGKRPVVRGVVMNPVDHPHGGGEGRAPIGRKKPTTPWGYPALGRRSRKRNKYSDNLILRRRSK

SEQ ID NO: 7911 - protein, 274 aa, Vitis vinifera
MAIHLYKTSTPSTRNRAVDSQVKSNPRNNLIYGQHRCGKGRNARGIITAGHRGGGHKRLYRKIDFRRNEKDIYGRIVTIEYDPNRNAYICLIHYGDGEKRYILHPRGAIIGDTIVSGTEVPIKMGNALPLTDMPLGTAIHNIEITLGKGGQLARAAGAVAKLIAKEGKSATLKLPSGEVRLISKNCSATVGQVGNVGVNQKSLGRAGSKCWLGKRPVVRGVVMNPVDHPHGGGEGRAPIGRKKPTTPWGYPALGRRSRKRNKYSDNLILRRRSK

SEQ ID NO: 7912 - protein, 274 aa, Heritiera littoralis
MAIHLYKTSTPGTRNGAVDSQVKSNPRNNLIYGQHRCGKGRNARGIITARHRGGGHKRLYRKIDFRRNEKDIYGRIVTIEYDPNRNAYICLIHYGDGEKRYILHPRGAIIGDTIVSGTEVPIKMGNALPLTDMPLGTAIHNIEITLGRGGQLARAAGAVAKLIAKEGKSATLKLPSGEVRLISKNCSATVGQVGNVGVNQKSLGRAGSKCWLGKRPVVRGVVMNPVDHPHGGGEGRAPIGRKKPATPWGYPALGRRSRKRNKYSENCILRRRSK

SEQ ID NO: 7913 - protein, 274 aa, Raphanus sativus
MAIHLYKTSTPSTRNGAVDSQVKSNPRNNLIYGQHHCGKGRNARGIITVRHRGGGHKRLYRKIDFRRNTKDIYGRIVTIEYDPNRNAYICLIHYGDGEKRYILHPRGAIIGDTIVSGTEVPIKMGNALPLTDMPLGTAIHNIEITLGKGGQLARAAGAVAKLIAKEGKSATLKLPSGEVRLISKNCSATVGQVGNVGVNQKSLGRAGSKCWLGKRPVVRGVVMNPVDHPHGGGEGRAPIGRKKPVTPWGYPALGRRTRKRKKYSETLILRRRSK

SEQ ID NO: 7914 - protein, 274 aa, Cucumis sativus
MAIHLYKTSTPSTRNGAVDSQVKSNPRNNLIYGQHRCGKGRNARGIITAGHRGGGHKRLYRKIDFRRNEKDIYGRIVTIEYDPNRNAYICLIHYGDGEKRYILHPRGAIIGDTIVSGTEVPIKMGNALPLTDMPLGTAIHNIEITLGKGGQLARAAGAVAKLIAKEGKSATLKLPSGEVRLISKNCSATVGQVGNAGVNQKSLGRAGSKCWLGKRPVVRGVVMNPVDHPHGGGEGRAPIGRKKPATPWGYPALGRRSRKRNKYSDNLILRRRSK

SEQ ID NO: 7915 - protein, 274 aa, Panax ginseng
MAIHLYKTSTPSTRNRAVDSQVKSNPRNNLIYGQHHCGKGRNARGIITAGHRGGGHKRLYRKIDFRRNEKDIYGRIVTIEYDPNRNAYICLIHYGDGEKRYILHPRGAIIGDTIVSGTEVPIKMGNALPLTDMPLGTAIHNIEITRGKGGQLARAAGAVAKLIAKEGKSATLKLPSGEVRLISKNCSATVGQVGNVGVNQKSLGRAGSKRWLGKRPVVRGVVMNPVDHPHGGGEGRAPIGRKKPTTPWGYPALGRRSRKRNKYSDNLILRRRSK

SEQ ID NO: 7916 - protein, 274 aa, Papaver somniferum
MAIHLYKTSTPSTRNGAVDSQVKSNSRNNLISGQRHCGKGRNARGVITARHRGGGHKRLYRKIDFRRNEKDISGRIVTIEYDPNRNAYICLIHYGDGEKRYILHPRGAIIGDTIVSGTEVPISMGNALPLTDMPLGTAIHNIEITLGKGGQLARAAGAVAKLIAKEGKSATLKLPSGEVRLISKNCSATVGQVGNVGVNQKSLGRAGSKRWLGKRPVVRGVVMNPVDHPHGGGEGRAPIGRKQPTTPWGYPALGRRSRKRNKYSDSLILRRRTK

SEQ ID NO: 7917 - protein, 82 aa, Silene vulgaris
MLLYFFVQNFLYNPVFFDLLVDLQNSFLVVQTKGNNDFGLYQVGNQVDLFFVPYYPIILTLKKIQVFGKCWIEQDFMLISFR

SEQ ID NO: 7918 - protein, 327 aa, Arabidopsis lyrata
MVREKVKVSTRTLQWKCVESKRDSKRLYYGRFILSPLMKGQADTIGIAMRRALLGEIEGTCITRAKSENIPHDYSNIVGIQESVHEILMNLNEIVLRSNLYGTRNALICVQGPGYITARDIILPPSVEIIDNTQHIATLTETIDLCIELKIERNRGYSLKMSNNFEDRSYPIDAVFMPVENANHSIHSYGNGNEKQEILFLEIWTNGSLTPKEALHEASRNLINLFIPFLHVEEETFYLENNQHQVTLPFFPFHNRLVNLRKKTKELAFQYIFIDQLELPPRIYNCLKKSNIHTLLDLLNNSQEDLIKIEHFHVEDVKKILDILEKK

SEQ ID NO: 7919 - protein, 274 aa, Antirrhinum majus
MAIHLYKTSTPSTRNGTVDSQVKSNPRNNLIYGQHHCGKGRNARGIITARHRGGGHKRLYRKIDFRRNEKDIYGRIVTIEYDPNRNAYICLIHYGDGEKRYILHPRGAIIGDTIVSGTEVPIKMGNALPLTDMPLGTAIHNIEITLGKGGQLVRAAGAVAKLIAKEGKSATLKLPSGEVRLISKNCSATVGQVGNVGANQKSLGRAGSKRWLGKRPVVRGVVMNPVDHPHGGGEGRAPIGRKKPTTPWGYPALGRRSRKRNKYSDNLIVRRRSK

SEQ ID NO: 7920 - protein, 2279 aa, Malus domestica
MKGHQFKSWIFELREILREIQNSHYFLDSWTKFNSVGSFIHIFFHQERFIKLLDSRIWSILLSRNSHLQGSTSNRYFTIKGVVLFVVAVLIYRINNRKMVERKNLYLTGLLPIPMNFIGPRNDTLEESFGSSNINRLIVSLLYLPKGKKISESCFLDPKESTWVLPITKKCIMPESNWGSRWWRNWIGKKRASSCKISNETVAGIEISFKEKDIKYLEFLFVYYMDDPIRKDHDWELFDRLSPRKRRNIINLNSGQLFEILVKDWICYLMFAFREKIPMEAEGFFKQQGAGSTIQSNEIEHVSHLFSRNKWAMQNCAQFHMRQFRQDLFFSWGKNPHESDFLRNISRENWLDNVWLLNKDRFFSKVRNASSNIQYDSTRSSFVQVTDSSQLKGSSDQSRDHFDSISNEDSEYHTLINQREIQQLKERSILWDPSFLQTERTEIESDRFPKCLSGYSSMSRLFTEREKQMNKHLLPEEIEEFLGNPTRSIRSFFSDRWSELHLGSNPTERSTRDQKLLKKEQDVSFVPSRRSENKEIVNIFKIITYLQNTVSIHPISSDPGCDMVPKDELDMDSSNKISFLNKNPFFDLFHLFHDRNRGGYTLHHDFESEERFKEMADLFTLSITEPDLVYHKGFAFSIGLDQKQFLNEVFNSRDESKKKSLLVLPPIFYEENESFYRRIRKKWVRTSCGNDLEDPKSKIVVFASNNIMEAVNQYRLIRNLIQIQYSTYGYIRNVLNRFFLMNRSDRNFEYGIQRDQIGNDTLNHRTIMKYTINQHLSNLKKSQKKWFDPLIFISRTERSMNRDPNAYRYKWSNGSKNLQEHLEHFISEQKSRFHFQVVFDRLRINQYSIDIDFDWSEVIDKKDLSKSLPFFLSKLLLFLSKFLLFLSNSLPFFFVSFGNIPIHRSEIHIYELKGPNDQLCNQLLESIGLQIVHLKKLKPFLLDDHDTSQKSKFLINGGTISPFLFNKIPKWMIDSFHTRNNRRKSFDNMDSYFSMISHDQDNWLNPVKPFHRSSLISSFYKANRLRFLNNPHHFCFYCNKGFPFYVEKARINNYDFTYGQFLNILFIRNKIFSLCGGKKKYAFLERDTISPIELQVSNIFIPNDFPQNGDERDNLYKSLHFPIRSDPFVRRAIYSIADISGTLLTEGQIVNFERTYCQPLSDMNLSDSEGKNLHQYLNFNSNMGLIHTPCSEKYLPSEKRKKRGLCLKKCLEKGRMYRTFQRDSAFSTLSKWNIFQTYMPWFLTSTGYKYLNLIFLDTFSDLLPILSSSQKFVSIFHDIMHGSDISWRILQKKLCLPQWNLISDISSKCLHNLLLSEEMIHRNNESPLISTHLRSPNVREFLYSILFLLLVAGYLVRTHLLFVSRAYSELQTEFERVKSLMIPSYMIELRKLLDRYPTSELNSFWLKNLFLVAREQLGDSLEEIRASGGNMLWGGGPAYGVKSIRSKKKYLNINLIDIIDFISIIPNPINRIAFSRNTRHLSHTSKEIHSLIRKRKNVNGDWIDDKIESWVSNSDSIDDKEREFLVQFSTLTTEKRIDQILLSLTHSDHLSKNDSGYQMIEQPGAIYLRYLVDIHKKYLMNYEFNTSCLAERRIFLAHYQTITYSQTSCGANSFHFPSHGKPFSLRLALSLSRGILVIGSIGTGRSYLVKYLATNSYVPFITVFLNKFLANKPKGFLVDDSDDIDDSDDIDDSDDRDFDTELALLTMMNALTMDMMPEIDRFYITLQFELAKAMSPCIIWIPNIHDLDVNESNYLSLGLLVNYLSRDCERCSTRNILVIASTHIPQKVDPALIAPNKLNTCIKIRRLLIPQQRKHFFTLSYTRGFHLEKKMFHTNGFGSITMGSNVRDLVALTNEALSISITQKKSIIDTNIIRSALHRQTWDLRSQVRSVQDHGILFYQIGRAVAQNVLLSNCSIDPISIYMKKKSCNEGDSYLYKWYFELGTSMKKLTILLYLLSCSAGSVAQDLWSLPRPDEKNGITSYGLVENDSDLVHGLLEAEGAPVGSSRTEKDCSQFDNDRVTLLLRPEPRNPLDMMQNGSCSIVDQRFLYEQYESEFEEGEGVLDPQRIEEDLFNHIVWAPRIWRPWGFLFDCIERPNELGFPYWVRSFRGKRIIYDEEDGLQENDSEFLQSGTMQYQTRDRSSKEQGFFRISQFIWDPADPLFFLFKDQPVFSHREFFADEEMSKGLLTSQTDLPTSIYKRWFIKNTQERYFELLIHRQRWLRTNSSLSNGFFRSNTPSESYQYLSKLFLSNGTLLDQMTKTLLRKRWLFPDEMKIGFM

SEQ ID NO: 7921 - protein, 274 aa, Guizotia abyssinica
MAMRLYKTSTPSTRNGTVDSQVKSNPRNNLIYGQHHCGKGRNARGIITAGHRGGGHKRLYRKIDFRRNEKDIYGRIVTIEYDPNRNAYICLIHYRDGEKRYILHPRGAIIGDTIVSGTEVPIKMGNALPLTDMPLGTAIHNIEITLGKGGQLARAAGAVAKLIAKEGKSATLKLPSGEVRLISKNCSATVGQVGNVGVNQKSLGRAGSKRWLGKRPVVRGVVMNPVDHPHGGGEGRAPIGRKKPTTPWGYPALGKRSRKRNKYSDNLILRRRSK

SEQ ID NO: 7922 - protein, 268 aa, Euphorbia peplus
MVREKVTISTRTLQWKCVESRKDNKRLYYGRFILSPLMKGQSDTIGIAIRRALLGEIEGTCITRAKFEKISHEFSTITGIQESIHEILMNLKEIILRSNLYGTCDASICVKGPGYVTAQDIILPPFVEIIDNTQHIASLTEPIDLCIRLQIERNRGYRIKPTKTFQDGSFPLDAVFMPVRNANHSVHSYGNGNEKQEMLFLEIWTNGSLTPKEALHEASRNLIDLFIPFLHADEQNLPLEKNQHNVTLPLFIFHDRLTKLRKKKKKYH

SEQ ID NO: 7923 - protein, 353 aa, Zostera marina
MTAILERRESTSLWGRFCNWVTNTENRLYIGWFGVLMIPTLLTATSVFIIAFIAAPPVDIDGIREPVSGSLLYGNNIISGAIIPTSAAIGLHFYPIWEAASVDEWLYNGGPYELIVLHFLLGVACYMGREWELSFRLGMRPWIAVAYSAPVAAATAVFLIYPIGQGSFSDGMPLGISGTFNFMIVFQAEHNILMHPFHMLGVAGVFGGSLFSAMHGSLVTSSLIRETTENESANVGYRFGQEEETYNIVAAHGYFGRLIFQYASFNNSRSLHFFLAAWPVVGIWFTALGISTMAFNLNGFNFNQSVVDSQGRVINTWADIINRANLGMEVMHERNAHNFPLDLAAVEAPSING

SEQ ID NO: 7924 - protein, 274 aa, Triphysaria pusilla
MTIHLYKTSTPSTRNGTIDSQVKSNPRNNLIYGQHHCGKGRNARGIITARHRGGGHKRLYRKIDFRRNEKDIYGRIVTIEYDPNRNAYICLIHYGDGEKRYILHPRGAIIGDTIVSGTEVPIKMGNALPLTDMPLGTAIHNIEITLGKGGQLVRAAGAVAKLIAKEGKSATLKLPSGEVRLISKNCSATVGQVGNVGANQKSLGRAGSKRWLGKRPVVRGVVMNPVDHPHGGGEGRAPIGRKKPTTPWGYPALGRRSRKRNKYSDNLIVRRRSK

SEQ ID NO: 7925 - protein, 1537 aa, Cannabis sativa
MKGHQFKSWIFELREILREIKNSHYFLDSWTQLNSVISFIHIFFHQERFIKLLDSRIWSILLSRNSHLQGSTSNRYFTIKGVVLFVVAVLIYRINNRKMVERKNLYLTGLLPIPMNFIGPRNDTLEESFWSSNINRLIVSLLYLPKGKKISESCFLDPKESTWVLPITKKCIMPESNWGSRWWRNWLGKKRDSSCKISNETVAGIEISFKEKDIKYLEFLFVYYMDDPIRKDHDWELFDRLSPRKRRNIINLNSAQLFEILVKDWICYLMFAFREKIPIEAKGFFKQQGAGSTIQSNDIEHVSHLFSRNKWAISLQNCAQFHMWQFRQDLFFSWGKNPHESDFLRNISRENWIWLDNVWLENKDRFFSKVRNVSSNIQYDSTRSSFVQVTDYSQLKGSSDRSRYHFDSISNEDSEYHTLINQREIQQLKERSILWDPSFLQTERTEIESDRFPKCLSGYSSMSRLFTEREKQMIIHLLPEEIEEFLGNPTRSIRSFFSDRWSELHLGSNPTERSTRDQKLLKKEQDVSFVPSRRSENKEIVNIFKIITYLQNTVSIHPISSDPGCDMVPKDELDMDSSNKISFLNKNPFFDLVHLFHDRNRGGYTLHHDFESEERFQEMADLFTLSITEPDLVYHKGFALSIDSYRLDQKQFLNEVFNSRDESKKKYLLVLPPIFYEENESFYRRIRKKWVRTSCGNDLEDPKPKIMVFASNNIMEAVNQYRLIRNLIQIQYSTYGYIRNVLNRFFLMNRSDRNFEYVIQRDQIGNDTLNHRTIMKYMINQHFSNLKKSQKKWFDPLIFISRTERSMNRDPNAYRYKWSNGSKNLQEHLEHFISEQKSRFHFQVVFDRLRINQYSIDWSEVIDKKDLSKSLPFFLSKLLLFLSKFLLFLSNSLPFFFVSFGNIPIHRSEIHIYELKGPNDQLCHQLLESIGLQIVHLKKWKPFLLDDHDTSQKSKFLINGGTISPFLFNKIPKWMIDSFHTRNNRRKSFDNTDSYFSMISHDQDNWLNPVKPFHRSSLISSFYKANRLRFLNNPHHFCFYCNKGFPFYVEKARINNYDFTYGQFLNILFIRNKIFSLRGGKKKYAFLERDTISPIELQVSNIFIPNDFPQNGDERYNLYKSFHFPIRSDPFVRRAIYSIADISGILLTGGQIVNFERTYCQPLSDINLSDSEEKNLHQYLNFNSNMGLIHTPCSEKYLPSEKRKKRGLCLKKCLEKGQMYRTFQRDSAFSTLSKWNIFQTYMPWFLTSTGYKYLNLIFLDTFSDLLPILSSSPKFVSIFHDIMHGLDISWRILQKKFCLPQWNLISEISSKCLHNLLLSKEMIHRNNESPLISTHLRSPNVRVREFLYSILFLLLVAGYLVRTHLLFVSRAYSELQTEFERVKSLMIPSYMIELRKLLDRYPTSELNSFWLKNLFLVAREQLGDSLEEIQGSASGGNMLWGGGPTYGVKSIRSKKKYLNINLIDIIDFISIIPNPINRISFSINTRHLSHTSKETYSLIRKRKKVNSDWIDDKIESWVSNMIGLMIKKESSWFSSPP

SEQ ID NO: 7926 - protein, 52 aa, Cynara scolymus
  misc_feature (37)..(37): Xaa can be any naturally occurring amino acid
MNPVDHPHGGGEGRAPIGRKKPTTPWGYPALGKRSRXRNKYSDNLILRRRSK

SEQ ID NO: 7927 - protein, 713 aa, Eutrema halophilum
MKGHQFKSWIFELREIVREIKNSHYFLDSWTQFNSVGSFIHIFFHQERFIKLLDPRIFSILLLRNSQGSTSNRYFTIKGVVLFVVAALLYRINNRNMVESKNLYLKGLLPIPMNSIGPRNDTSEESFGSSNINRLIVSLLYLTKGKKISESCFRDPKESTWVLPITKKCIMPESNWSSRWWRNWIGKKRDFCCKISNETVAGIDISFKEKDIKYLEFLFVYYMDDPIRKGHDWELFDRLSPSKRRNIINLNSGQLFEILVKDWICYLMFAFREKIPIEVEGFFKQQGAGSTIQSNDIEHVSHLFSRNKWAISLQNCAQFHMWQFHQDLFVSWGKNPHESDFLRKISRENWIWLDNVWLVNKDRFFSKVRNVSSNIQYDSTRSSFVQVTDSSQLNGSSDQFIDPFDSISNEDSEYHYHTLINQREIQQLKERSILWDPSFIQTEGREIESDRFPKYLSGYSSMPRLFTEREKRMNNHPLPEESEEFLGNPTRAIRSFFSDRWSELHLGSNPTERSTRDQKLLKKEQDVSFVPSRRSENKEIVNIFKIITYLQNTVSIHPISSDLGCGMVPKDELDMDSSNKISFLNKNPFFDLFHLFHERKRGGYTLRHDFESEERFQEMADLFTLSITEPDLVYHKGFAFSIDSSGLDQRQFLKEVFNFRDESKKKSLLVLPPIFYEENESFIEGSEKIGSGSPAGIIWKIQNQKEWYLLATT

SEQ ID NO: 7928 - protein, 277 aa, Ricinus communis
MAIHLYKTSTPSTRNGAVDSQVKSNTRNTRNNLIYGQHRCGKGRNARGIITARHRGGGHKRLYRKIDFRRNEKDIYGRIVTIEYDPNRNAYICLIHYGDGEKRYILHPRGAIIGDTIISGTEVPIKMGNALPLTDMPLGTAIHNIEITFGKGGQLARAAGAVAKLIAKEGKSATLKLPSGEVRLISKNCSATVGQVGNTGVNQKSLGRAGSKCWLGKRPVVRGVVMNPVDHPHGGGEGRAPIGRKKPATPWGYPALGRRSRKRNKYSDNLILRRRSK

SEQ ID NO: 7929 - protein, 275 aa, Vigna unguiculata
MAIHLYKTSTPSTRNGTVDSRQVKSNPRNHLIYGQHRCGKGRNARGIITAGHRGGGHKRLYRQIDFRRNEKNIYGRIVTIEYDPNRNASICLIHYGDGEKKYILHPRGAIIGDTIVSGTEVPIKMGNALPLTDMPLGTAIHNIEITLGKGGQLARAAGAVAKLIAKEGKSATLKLPSGEVRLISKNCSATVGQVGNVGVNQKNLGRAGSKCWLGKRPIVRGVVMNPVDHPHGGGEGRAPIGRKKPATPWGFPALGRRSRKRKKYSDNLILRRRTK

SEQ ID NO: 7930 - protein, 274 aa, Lactuca sativa
MAIHLYKTSTPSTRNGAVDSKVKSNPRNNLIYGQHHCGKGRNARGIITAGHRGGGHKRLYRKIDFRRNEKDIYGRIVTIEYDPNRNAYICLIHYRDGEKRYILHPRGAIIGDTIVSGTEVPIKMGNALPLTDMPLGTAIHNIEITLGKGGQLARAAGAVAKLIAKEGKSATLKLPSGEVRLISKNCSATVGQVGNVGVNQKSLGRAGSKRWLGKRPVVRGVVMNPVDHPHGGGEGRAPIGRKQPTTPWGYPALGKRSRKRNKYSDNLILRRRSK

SEQ ID NO: 7931 - protein, 244 aa, Tripterygium wilfordii
MAIHLYKTSTPSTRNGAVDSQVKSNTRNNLIYGQHRCGKGRNARGIITAGHRGGGHKRLYRQIDFRRKEKDIYGRIVTIEYDPNRNAYICLIHYGDGEKRYILHPRGAIIGDTIVSGTEVPIKMGNALPLTDMPLGTAIHNIEITLGKGGQLARAAGAVAKLIAKEGKSATLKLPSGEVRLISKNCSATVGQVGNVGVNQKSLGKAGSKCWLGKRPIVRGVVMNPVDHPHGGGEGRAPIGRKNP

SEQ ID NO: 7932 - protein, 274 aa, Phaseolus coccineus
MAIHLYKTSTPSTRNGAVDSQVKSNPRNHLIYGQHRCGKGRNARGIITAGHRGGGHKRLYRQIDFRRNEKNIYGRIVTIEYDPNRNASICLIHYGDGEKKYILHPRGAIIGDTIVSGTEVPIKMGNALPLTDMPLGTAIHNIEITLGKGGQLARAAGAVAKLIAKEGKSATLKLPSGEVRLISKNCSATVGQVGNVGVNQKNLGRAGSKCWLGKRPIVRGVVMNPVDHPHGGGEGRAPIGRKKPATPWGFPALGRRSRKRKKYSDNLILRRRTK

SEQ ID NO: 7933 - protein, 278 aa, Arabidopsis lyrata
MAIHLYKTSTPSTRNGAVDSQVKSNPRNNLIYGQHHCGKGRNAKGIITARHKGGGHKRLYRKIDFRRNAKDIYGRIVTIEYDPNRNAYICLIHYGDSEKRYILHPRGAIIGDTIVFGTEVPIKMGNALPLKSTSTDMPLGTAIHNIEITLGKGGQLARAAGAVAKLIAKEGKSATLKLPSGEVRLISKNCSATVGQVGNVGVNQKSLGRAGSKCWLGKRPVVRGVVMNPVDHPHGGGEGRAPIGRKKPVTPWGYPALGRRTRKRKKYSETLILRRRSK

SEQ ID NO: 7934 - protein, 278 aa, Cannabis sativa
MAIHLYKTSTPSTRKGAVDRQVKSNPRNNLIYGQHRCGKGRNARGIITAGHRGGGHKRLYRKIDFRRNDKDIYGKIVTIEYDPNRNAYICLIHYGGGEKRYILHPRGALIGDTIVSGTEVPIKMGNALPLKSTSTDMPLGTAIHNIEITLGKGGQLARAAGAVAKLIAKEGKSATLKLPSGEVRLIPKNCSATVGQVGNVGVNQKSLGRAGSKRWLGKRPVVRGVVMNPVDHPHGGGEGRAPIGRKKPSTPWGYPALGRRSRKRNKYSDNLILRRRSK

SEQ ID NO: 7935 - protein, 278 aa, Glycine max
MAIHLYKTSTPSTRNGAVDSQVKSNPRNHLIYGQHRCGKGRNARGIITAGHRGGGHKRLYRKIDFRRNEKNIYGRIVTIEYDPNRNAYICLIHYGDGEKKYILHPRGAIIGDTIVSGTEVPIKMGNALPLKSTSTDMPLGTAIHNIEITLGKGGQLARAAGAVAKLIAKEGKSATLKLPSGEVRLISKNCSATVGQVGNVGVNQKNLGRAGSKCWLGKRPVVRGVVMNPVDHPHGGGEGRAPIGRKKPATPWGFPALGRRSRKRKKYSDNLILRRRTK

SEQ ID NO: 7936 - protein, 218 aa, Arabidopsis lyrata
MGQKINPLGFRLGTTQSHHSLWFAQPKKYSEGLEEDKKIRDCIKNYVQKNIRISSGMEGIARIEIQKRINLIQIIIYMGFPKLLIEDKPRRVEELQINVQKELNCVNRKLNIAITRISNPYGDPNILAEFIAGQLKNRVSFRKAMKKAIELTEQANTKGIQVQIAGRIDGKEIARVEWIREGRVPLQTIEAKIDYCSYTVRTIYGVLGIKIWIFVDEE

SEQ ID NO: 7937 - protein, 274 aa, Phaseolus coccineus
MAIHLYKTSTPSTRNGAVDSQVKSNPRNHLIYGQHRCGKGRNARGIITAGHRGGGHKRLYRQIDFRRNEKNIYGRIVTIEYDPNRNASICLIHYGDGEKKYILHPRGAIIGDTIVSGTEVPIKMGNALPLTDMPLGTAIHNIEITLGKGGQLARAAGAVAKLIAKEGKSATLKLPSGEVRLISKNCSATVGQVGNVGVNQKNLGRAGSKCWLGKRPIVRGVVMNPVDHPHGGGEGRAPIGRKKPATPWGFPALGRRSRKKKKYSDNLILRRRTK

SEQ ID NO: 7938 - protein, 274 aa, Trigonella foenum-graecum
MAIHLYKTSIPSTRNGAVGSQVKSNSRNRLIYGQHHCGKGRNARGIITAGHRGGGHKRLYRKIDFRRNEKDIYGRIVTIEYDPNRNAHICLIHYGDGEKRYILHPRGAIIGDTIVYGTEVPIKMGNALPLTDMPLGTAIHNIEITLGKGGQLARAAGAVAKLIAKEGKSATLKLPSGEVRLISKNCSATVGQVGNVGVNQKSLGRAGAKRWLGKRPVVRGVVMNPVDHPHGGGEGRAPIGRKKPSTPWGYPALGRRSRKKNKYSDNLILRRRSK

SEQ ID NO: 7939 - protein, 256 aa, Plantago ovata
MAIHLYKTSTPSTRNGTVDSQVKSNPRNNLIYGQHHCGKGRNARGIITTRHRGGGHKRLYRKIDFRRNEKDIYGRIVTIEYDPNRNAYICLIHYGDGEKRYILHPRGALIGDTIVSGTEVPIKVGNALPLTDMPLGTAIHNIEITLGKGGQLVRAAGAVAKLIAKEGKSATLKLPSGEVRLISKNCSATVGQVGNVGAKQKSLGRAGAKRWLGKRPVVRGVVMNPVDHPHGGGRGEPPLVEKTHNSLGLSCTWKKK

SEQ ID NO: 7940 - protein, 278 aa, Eutrema halophilum
MAIHLSKTSTPSTRNGAVDSQVKSNPRNNLIYGQHHCGKGHNARGIITVRHRGGGHKRLYRKIDFRRNAKDIYGRIVTIEYDPNRNAYICLIHYGDGEKRYILHPRGAIIGDTIVSGTEVPIKMGNALPLKSTSTDMPLGTAIHNIEITLGKGGQLARAAGAVAKLIAKEGKSATLKLPSGEVRLISKNCSATVGQVGNVGVNQKSLGRAGSKCWLGKRPVVRGVVMNPVDHPHGGGEGRAPIGRKKPVTPWGYPALGRRTRKKKKYSETLILLRRSK

SEQ ID NO: 7941 - protein, 278 aa, Lotus japonicus
MAIHLYKTSTPSTRNRAVDSQVKSNPRNRLIYGLHCCSKGRNARGIITAGHRGGGHKRLYRKIDFRRNEKNIYGKIVTIEYDPNRNAYICLIHYGDGEKRYILHPRGAIIGDTIVSGTEVPIKMGNALPLKSTSTDMPLGTAIHNIEITFGKGGKLARAAGAVAKLIAKEGKSATLKLPSGEVRLISKNCSATVGQVGNVGVNQKSLGRAGSKCWLGKRPVVRGVVMNPVDHPHGGGEGRAPIGRKKPVTPWGYPALGRRSRKRKKYSDNLILRRRTK

SEQ ID NO: 7942 - protein, 250 aa, Tabernaemontana elegans
TVDSQVKSNPRNNLIYGQHRCGKGRNARGIITAGHRGGGHKRLYRKIDFRRNEKDIYGRIVTIEYDPNRNAYICLIHYGDGEKRYILHPRGAIIGDTIVSGTEVPIKMGNALPLTDMPLGTAIHNIEITLGKGGQLARAAGAVAKLIAKEGKSATLKLPSGEVRLISKNCSATVGQVGNVGVNQKSLGRAGSKRWLGKRPVVRGVVMNPVDHPHGGGEGRAPIGRKNPQPLGVILHLEEEVEKGINIVII

SEQ ID NO: 7943 - protein, 155 aa, Manihot esculenta
MGNALPLKSTSTDMPLGTAIHNIEITFGKGGQLARAAGAVAKLIAKEEKSATLKLPSGEVRLISKNCSATVGQVGNTGVNQKSLGRAGSKCWLGKRPVVRGVVMNPIDHPHGGGEGRAPIGRKKSATPWGYPALGRRSRKRNKYSDNLILRRRSK

SEQ ID NO: 7944 - protein, 124 aa, Ananas comosus
MGNALPLTDMPLGTAIHNIEITRGKGGQLARAAGAVAKLIAKEGKSATLRLPSGEVRLISKNCLATVGQVGNVGVNQKSLGRAGSKCWLGKRPVVRGVVMNPVDHPHGGGEGRAPIGRKKPTTP

SEQ ID NO: 7945 - protein, 139 aa, Pisum sativum
MAIHLSKTSSPSTRNGAVNSQVKSNSRNRLISGQHHCGKGRNPRGIITAGHRGGGHKRLYRKIDFRRNEKDIYGRIITIEYDPNRNAHICLIHYGDGEKRYILHPKGYNWRYHCLWYRSSYKNGKCPTFDRYAVRHGHT

SEQ ID NO: 7946 - protein, 287 aa, Jatropha curcas
MAIHLYKTSTPSTRNGAVDSQVKSNTRNNLIYGQHRCGKGRNARGIITARHRGGGHKRLYRKIDFRRNEKDIYGRIVTIEYDPNRNAYICLIHYGDGEKRYILHPRGAIIGDTIISGTEVPIKMGNALPLSEVLIDQKEESTSTDMPLGTAIHNIEITLGKGGQLARAAGAVAKLIAKEGKSATLKLPSGEVRLISKNCSATVGQVGNTGVNQKSLGRAGSKCWLGKRPVVRGVVMNPVDHPHGGGEGRAPIGRKKPATPWGYPALGRRSRKRNKYSDNLILRRRTK

SEQ ID NO: 7947 - protein, 224 aa, Brassica napus
QVKSNPRNNLIYGQHHCGKGRNARGIITVRHRGGGHKRLYRKIDFRRNTKDIYGRIVTIEYDPNRNAYICLIHYGDGEKRYILHPRGAIIGDTIVSGTEVPIKMGNALPLTDMPLGTAIHNIEITLGKGGQLARAAGAVAKLIAKEGKSATLKLPSGEVRLISKNCSATVGQVGNVGVNQKSLGRAGSKCWLGKRPVVRGVVMNPVDHPHGGGEGRAPIGRKNP

SEQ ID NO: 7948 - protein, 261 aa, Tripterygium wilfordii
TRNGAVDSQVKSNTRNNLIYGQHRCGKGRNARGIITAGHRGGGHKRLYRQIDFRRKEKDIYGRIVTIEYDPNRNAYICLIHYGDGEKRYILHPRGAIIGDTIVSGTEVPIKMGNALPLTDMPLGTAIHNIEITLGKGGQLARAAGAVAKLIAKEGKSATLKLPSGEVRLISKNCSATVGQVGNVGVNQKSLGKAGSKCWLGKRPIVRGVVMNPVDHPHGGGEGRAPIGRKNPYPWGYPALGRRSRKRNKYSDNLILRRRSK

SEQ ID NO: 7949 - protein, 123 aa, Medicago truncatula
MAIHLYKTSIPSTRTRNRLIYGQHHCGKGRNARGIITAGHRGGGHKRLYRKIDFRRNEKDIYGRIVTIEYDPNRNAHICLIHYGDGEKRYILHPRGAIIGDTIVYGTEVPIKMGNALLQPICP

SEQ ID NO: 7950 - protein, 290 aa, Ricinus communis
MAIHLYKTSTPSTRNGAVDSQVKSNTRNTRNNLIYGQHRCGKGRNARGIITARHRGGGHKRLYRKIDFRRNEKDIYGRIVTIEYDPNRNAYICLIHYGDGEKRYILHPRGAIIGDTIISGTEVPIKMGNALPLSAVLIDQKEESTSTDMPLGTAIHNIEITFGKGGQLARAAGAVAKLIAKEGKSATLKLPSGEVRLISKNCSATVGQVGNTGVNQKSLGRAGSKCWLGKRPVVRGVVMNPVDHPHGGGEGRAPIGRKKPATPWGYPALGRRSRKRNKYSDNLILRRRSK

SEQ ID NO: 7951 - protein, 211 aa, Leymus cinereus x Leymus triticoides
MAKHLYKTPIPSTRKGTVDRQVKSNPRNNLIHGRHRCGKGRNSRGIITARHRGGGHKRLYRKIDFRRNQKDISGRIVTIEYDPNRNAYICLIHYGDGEKRYILHPRGAIIGDTIVSGTKVPISMGNALPLTDMPLGTAMHNIGITRGRGGQLARAARAVAKLIAKEGKSATLRLPSGEVRLVSQNCLATVGQVGNVGVNQKVWVEPDLSVG

SEQ ID NO: 7952 - protein, 75 aa, Lotus japonicus
MAIHLYKTSTGTRNRAVDSQVKSNPRNRLIYGLHRCSKGRNARGIITAGHGGGGHKRLYRKIDFRRNKKTYMGKS

SEQ ID NO: 7953 - protein, 247 aa, Liriodendron tulipifera
MAIHLYKTSTPSTRNGAVDSQVKSNPRNNLIHGQHHCGKGRNARGIITAGHRGGGHKRLYRKIDFRRNEKDTSGRIVTIEYDPNRNAYICLIHYGDGEKRYILHPRGAIIGDTIVSGTEVPISMGNALPLTDMPLGTAIHNIEITLGKGGQLARAAGAVAKLIAKEGKSATLRLPSGEVRLISKNCSATVGQVGNVGVNQKSLGRAGSKCWLGKRPVVRGVVMNPVDHPHGGGEGRAPIGRKKPTTP

SEQ ID NO: 7954 - protein, 124 aa, Manihot esculenta
MPLGTAIHNIEITFGKGGQLARAAGAVAKLIAKEEKSATLKLSSGELHLISKNCSATVGQVGNTGVNQKSLGRAGSKYWLGKRSVVRGVVMNPVDHPHGGGEGRAPIGRKKPATLGLSCTWKTK

SEQ ID NO: 7955 - protein, 266 aa, Glycine max
MAIHLYKTSTPSTRNGAVDSQVKSNPRNHLIYGQHRCGKGRNARGIITAGHRGGGHKRLYRKIDFRRNEKNIYGRIVTIEYDPNRNAYICLIHYGDGEKKYILHPRGAIIGDTIVSGTEVPIKMGNALPLTDMPLGTAIHNIEITLGKGGQLARAAGAVAKLIAKEGKSATLKLPSGEVRLISKNCSATVGQVGNVGVNQKNLGRAGSKCWLGKRPVVRGVVMNPVDHPHGGGEGRAPIGRKKPATPWGFLHLEEEVEKGRNIVII

SEQ ID NO: 7956 - protein, 124 aa, Ricinus communis
MPLGTAIHNIEITFGKGGQLARAAGAVAKLIAKEEKSATLKLSSGELHLISKNCSATVGQVGNTGVNQKSLGRAGSKYWLGKRSVLRGVVMNPVDHPHGGGEGRAPIGRKKPATLGLSCTWKKK

SEQ ID NO: 7957 - protein, 257 aa, Cucumis melo
MAIHLYKTSTPSTRNGAVDSQVKSNPRNNLIYGQHRCGKGRNARGIITAGHRGGGHKRLYRKIDFRRNEKDIYGRIVTIEYDPNRNAYICLIHYGDGEKRYILHPRGAIIGDTIVSGTEVPIKMGNALPLTDMPLGTAIHNIEITLGKGGQLARAAGAVAKLIAKEGKSATLKLPSGEVRLISKNCSATVGQVGNAGVNQKSLGRAGSKCWLGKRPVVRGVVMNPVDHPHGGGEGRAPIGRKKPRNPLGLSCTWKKK

SEQ ID NO: 7958 - protein, 298 aa, Brachypodium distachyon
ILNNTAKHLYKTPISSTRKGTVDRQVKSNPRNNLIHGRHRCGKGRNSRGIITARHRGGGHKCLYRKIDFRRNQKDISGRIVTIEYDPNRNAYICLIHYGDGEKRYILHPRGAIIGDTIVSGTKVLITMGNALPLSARKEESTSTDMPLGTAMHNIEITRGRGGQLARAAGAVAKLIAKEGKSATLRLPFGEVRLVSQNCLATVGQVGNVGVNQKSLGRAGSKCWLGKRPIVRGVVMNPHGGGEGKAPIGRKKPTTPWGYPALGRRTRKRKRRALKPNTLPTMEVNMLVTEPSSNRSNG

SEQ ID NO: 7959 - protein, 246 aa, Panicum virgatum
MPKIKNLSNACKVSFSPDGPISEEALERVRALLDEIRPLDVGLDNEAQIARNWNSSTRPSNGRRGRNGANQFTAPIKYLHIHECESFSMGIFCMPPSSVIPLHNHPGMTVLSKLLYGRLHAESYDWINVPDHPSDQLQARPAKLVRDCEMTAPETTILYPNRGGNIHTFRAITPCALFDVLSPPYSAEDGRHCSYFRKSLVNQQPVVLPTEIDSSQVVWLEELEDHQPPEGFVVARGLYKGPVIRR

SEQ ID NO: 7960 - protein, 246 aa, Setaria italica
MPKIKNLSNACKVSFSPDGPISEEALERVRALLEEIRPLDVGLDNEAQIARNWNSSTRSSNGRRGRNGANQFATPIKYLHIHECESFSMGIFCMPPSSVIPLHNHPGMTVLSKLLYGRLHAESYDWIDVPDHPIDQLQARPAKLVRDREMTAPETSILYPNRGGNIHTFRAITPCALFDVLSPPYSAEDGRHCSYFRKSLVNQPPVVLPAEIDSSQVVWLEELEDHQPPDGFVVARGLYKGPVIRI

SEQ ID NO: 7961 - protein, 246 aa, Pennisetum glaucum
MPKIKNLSNACKVSFSPDGPISEEALERVRALLDEIRPLDVGLDNEAQIARNWNSSTRPLNGRRGRNGASQFAAPIKYLHIHECESFSMGIFCMPPSSVIPLHNHPGMTVLSKLLYGTLHAESYDWIDVPDHPMDQLQARPAKLVRDREMTAPETSILYPNRGGNIHTFRAITPCALFDVLSPPYSAEDGRHCSYFRKSLVNQPPVVLPAEIDGSQVIWLEELEDHQPPDGFVVARGLYKGPVIRR

SEQ ID NO: 7962 - protein, 245 aa, Brachypodium distachyon
MPKIKNLSEACKVSFSPGGPISEEALERVRALLDEIRPLDVGLDNEAQIARNWNSSARQQNGRRGRNGSNQCAPPIKYLHIHECESFSMGIFCMPPSSVIPLHNHPGMTVLSKLLYGKLHAESYDWIDVADPPGQLQPRPAKCVRDREMTAPETTILYPDRGGNIHTFRAVTPCALFDVLSPPYSAENGRDCSYFRKSLVKEPSVVLPSEINSSEVVWLEELEDHQPPEGFVVARGLYKGPVIRR

SEQ ID NO: 7963 - protein, 249 aa, Oryza sativa
MPKIKSLSNACKVSFSPDGPISDEALERVRALLDEIRPIDVGLDNEAQIARNWNNSTRQPNGRRGRNGANQFTSPIKYLHIHESESFSMGIFCMPPSSVIPLHNHPGMTVLSKLLYGTLHAESYDWIDVTDPTDQLQELSVRPARLVRDREMSAPETTILYPNRGGNIHTFRAITPCALFDVLSPPYSAEKGRDCSYFRKSSVRETPPVVLPGEINSAEVIWLEELEDHQPPEGFVVARGLYKGPVIRR

SEQ ID NO: 7964 - protein, 245 aa, Secale cereale
MPKIKNLSDACKVSFSPDGPISEETLERVRALLDEIRPLDLGLDNEAQIARTWNSSTRQQNGRRGRGGPNQYAPPIKYLHIHECESFSMGIFCMPPSSVIPLHNHPGMTVLSKLLYGKLHAESYDWIDVADPTDPLKPRPARCVRDREMTAPETTILYPDRGGNIHTFRAITPCALFDVLSPPYSAENGRDCSYFRKSSVKEPSVVLPSEIDSSEVVWLEELEDHQPPEGFVVARGLYKGPVIRR

SEQ ID NO: 7965 - protein, 245 aa, Hordeum vulgare
MPKIKNLSDACKVSFSPDGPISEETLERVRALLDEIRPLDLGLDNEAQIARNWNSSTRQQNGRRGRGGPNQYAPSIKYLHIHECESFSMGIFCMPPSSVIPLHNHPGMTVLSKLLYGKLHAESYDWIDVADPTDPLKPRPARCVRDREMTAPETTILYPDRGGNIHTFRAITPCALFDVLSPPYSAENGRDCSYFRKSPVKEPSVVLPSEIDSSEVVWLEELEDHQPPEGFVVARGLYKGPVIRR

SEQ ID NO: 7966 - protein, 245 aa, Triticum aestivum
MPKIKNLSDACKVSFSPDGPISEETLERVRALLDEIRPLDLGLDNEAQIARTWNSSTRQQNGRRGRGGPNQYAPTIKYLHIHECESFSMGIFCMPPSSVIPLHNHPGMTVLSKLLYGKLHAESYDWIDVADPTDPLKPRPARCVRDREMTAPETTILYPDRGGNIHTFRAITPCALFDVLSPPYSAENGRDCSYFQKSSVKEPSVVLPSEIDSSEVVWLEELEDHQPPEGFVVARGLYKGPVIRR

SEQ ID NO: 7967 - protein, 245 aa, Avena sativa
MPKIKNLSDACKVSFSPDGPISEEALERVRALLDEIRPLDLGLDNEAQIARTWNSSTRQQNGRRGRGGPNQYVPPIKYLHILESESFSMGIFCMPPSSVIPLHNHPAMTVLSKLLYGKLQAESYDWIDAADPTDPLKPRPARCVRDREMTAPETTILYPDRGGNIHTFRAITPCALFDVLTPPYSAEKGRDCSYFRKSSVKEPPVVLPSEVDSSEVVWLEELEDHQPPEGFVVARGLYKGPVIRR

SEQ ID NO: 7968 - protein, 107 aa, Avena sativa
MPKIKNLSDACKVSFSPDGPISEEALERVRALLDEIRPLDLGLDNEAQIARTWNSSTRQQNGRRGRGGPNQYVPPIKYLHILESESFSMGIFCMPRHQLFLFIIIQP

SEQ ID NO: 7969 - protein, 397 aa, Zea mays
MGDAVDDIICATDAAVAVEDAASGKPAMLSSLGGQGEEEHEEKDNEDKSGESEVINPPEDAGGEATSPLEGLKPRLSKGNQSHGPNAVKSKSPTSGDEGQTRKKAPNSSLPKAPIVQVSHGDAGVGSNKDGKNESRSSSVDATLLDDSKEKRKTQKPLAQLFSIKSDEEQSNGESAKPRKVGSIPSYGFTFKCDERSEKRREFYSKLEEKIHARELEISNLQAKSKETEEAELKMLRKSLNFKATPMPSFYKEPTPVKVELKKIPPTRAKSPKFGRSKNKSTPETEENATADQPAHLSLEENVSQTGVKKPTPLNPAKKPQRKSLPRLPSEETGPLDATSRQLIKSAKLDAVSAPETGSATGQAQLQGSQTETDSGQGPVEAGANPDEQDASEQSVV

SEQ ID NO: 7970 - protein, 388 aa, Zea mays
MDDVVDDIICGTDAAVAVEDGASGTPAMPSLGCQGEEEHRKGNEDNSGESEVINPPEEAGGEATSPLEGRKPRLSKGNQSHVPKAVKSKSPRSGDENQTRRKAPNSSFPKAPIVQESHGDSGVGSNKAGKNESHSSPIDAALPDESKEKRKTQKPPAQLSSIKRDEEQSNGESAKPRKVGSTPSYGFTFKCDERSEKRREFYSKLEEKIHARELEISNLQAKSKETEEAELKMLRKSLNFKATPMPSFYKEPTPAKVELKKIPPTRAKSPKLGRSKNKSISETEENTTTDQPARLSLDEKVSQNGVKKPTPSSSAKKPQRKSLPRLPSEETCPLDATSRQLKNNKLDEVNAQETGSATGQVQGSETETDSVQSATQAGANPDEQSVAQ

SEQ ID NO: 7971 - protein, 524 aa, Setaria italica
MATGTRRPWWAPPPSTVTAPPSAPPFPSPPSSFTADPPEEFLCPISGSLMADPVVVPPGQTFERACIQVCAALAFSPPAVAADLAASVSSSSPLVLVPNVALRTAILNWCDRLGLPHPAPLSPDTAHDIVCRLMPPQREDQSSKPQQRPQVASSVRFRRQSVDGFAQEPSPRQRGDALEEEIMAVLGAEGATPAEQASAMASLRQATRENREVRRQLCTPRLLAALRPMLLSADAGVQSNAAAAMVNLSLEPENKVRIVRSGAVSPLVDVLRGGHPEARDHAAGAMYSLAVEDENRAAIGVLGAIPPLLELFAGAAGAAAAGYRARREAGMALYHVSLSGMNRSKIARAPGAVRTLLAAAEARDRSNEADAAALRRLAVMILANLAGCPDGRAALMDGGAVAAVVGLMRNGSAAPGSAEEEYCISTLYGMSRGSMRFRGLARAAGVEAALQPVAEGGGGVGRDMARRTLRAMRGEDDEAPVTATGLLGRQWDDGSVVSEGLVSIRRPPHRSNYAGPSGSNTTQF

SEQ ID NO: 7972 - protein, 508 aa, Zea mays
MATGTGRPWWAPAPPAAARSAPLFPSPPSSFTADPPAEFLCPISGTLMADPVVAPPGQTFERACIQACAALAFSPPTVAVDLSESHSCSSAPLVLIPNVALRNAILNWCDRLALPHPSPMSPDTAHDIVRRLMPQDRQRSSLAQRPQPQVQQQPSSRQRGDALEEEIMAALGTEGATPAEQASAMALLRQATRENREVRRQLCTPRLLAALRPMLLSADADVQVNAAAAVVNLSLEPENKVRIVRSGAVSPLVDVLRGGHTEARDHAAGAMYSLAVEDENRAAIGVLGAIPPLLDLFAGAAAHRARREAGMALYHISLSGMNRPKIARAPGAVRTLLAVAAAEARRDRASDADAAALRRLAAMILANLAGCPDGRAALMDGGAVAAVVRLMRCGSAAPGSTEEEYCISTLYGMSRGSMRFRGLARAAGVEAALQPVAEGGGGVRRDLARRTLRAMRGEDDEAPAMDSGLLGRQWDDGSVVSEGLVSIRRPPPHRSNHAGPSGSNTTQF

SEQ ID NO: 7973 - protein, 403 aa, Sorghum bicolor
MADGEPSLTRWTFEDFVVYYETRLGIRREANGDDGDEGPTPRGSDHAAGHRPAAARANGGGADLAVFEQFERMERKVEIRNGAIEDGPPQKPLLPSFESAEMRNLAETLLRDIIRGSPDVKWESIKGLENAKRLLKEAVVMPIKYPKYFTGLLSPWKGILLFGPPGTGKTMLAKAVATECKTTFFNISASSIVSKWRGDSEKLVKVLFELARHHAPSTIFLDEIDAIISQRGEARSEHEASRRLKTELLIQMDGLTKTDELVFVLAATNLPWELDAAMLRRLEKRILVPLPEPDARQAMFEELLPSTPGKMEIPYNVLVEKTEGYSGSDIRLVCKEAAMQPLRRLMTVLERRQEEVPEDELPEVGPVTTEDIELALRNTRPSAHLHAHRYEKFNQDYGSHVHG

SEQ ID NO: 7974 - protein, 202 aa, Saccharum officinarum
MADGEPSLTRWTFEDFVVYYETRLGIRREPNGDDGDDRDEGPTPRGGSDHAASHHPAAAVRANGGADLAVFEQFERMERKVEVRNGAIEDGPPQKPQLPSFESAEMRNLAETLLRDIIRGSPDVKWESIKGLENAKRLLKEAVVMPIKYPKYFTGLLSPWKGILLFGPPGTGKTMLAKAVATECKTTFFNISASSIGEQVAW

SEQ ID NO: 7975 - protein, 402 aa, Panicum virgatum
MADGEPSLTRWTFEDFEAYYEARLGVRREPAEDGDDGPQPHGSDHLAGSPSMPRANGGADLAVFEQFERMVLERKVEARNGAIEDGPPLKPLLPSFESAEMRNLAETLLRDIIRGSPDVKWESIKGLENAKRLLKEAVVMPIKYPKYFTGLLSPWKGILLFGPPGTGKTMLAKAVATECKTTFFNISASSIVSKWRGDSEKLVKVLFELARHHAPSTIFLDEIDAIISQRGEARSEHEASRRLKTELLIQMDGLTKTDELVFVLAATNLPWELDAAMLRRLEKRILVPLPEPDARHAMFEELLPSGPCRMEIPYDVLVEKTEGYSGSDIRLVCKEAAMQPLRRLMTVLERNQEEVPEDELPEVGPITSEDIELALRNTRPSAHLHAHRYEKFNQDYGSHVHG

SEQ ID NO: 7976 - protein, 398 aa, Zea mays
MADGEPSLTRWTFEDFVVHYEARFGLRREADGDDAPPPRGSDHGASRPATARANGGADLAVFEQFERMERKVEISNGAIEDGPLQKSLLPSFESAEMRNLAETLLRDIIRGSPDVKWESIKGLENAKRLLKEAVVMPIKYPKYFTGLLSPWKGILLFGPPGTGKTMLAKAVATECKTTFFNISASSIVSKWRGDSEKLVKVLFELARHHAPSTIFLDEIDAIISQRGEARSEHEASRRLKTELLIQMDGLTKTDELVFVLAATNLPWELDAAMLRRLEKRILVPLPEPDARHAMFEELLPYTPGTMEIPYDVLVEKTEGYSGSDIRLVCKEAAMQPLRRVMAVLEGRKEEVPEGELPEVGPVTTEDIELALRNTRPSAHLHAHRYEKFNQDYGSHVHG

SEQ ID NO: 7977 - protein, 410 aa, Oryza sativa
MTGADEPSITRWTFEDFEVYYEVRLGIRREPGGDEDGDGDGGGGRGYAPLGSGSAGSTRPSAAHANGGADLAVFEQFERLERKVELRNGAIEAGPPQKSLLPSFESAEMRNLAETLLRDIIRGSPDVKWESIKGLENAKRLLKEAVVMPIKYPKYFKGLLSPWKGILLFGPPGTGKTMLAKAVATECKTTFFNISASSIVSKWRGDSEKLVKVLFELARHHAPSTIFLDEIDAIISQRGEARSEHEASRRLKTELLIQMDGLTKTDDLVFVLAATNLPWELDAAMLRRLEKRILVPLPEQEARHAMFEELLPSVPGTMNIPYDVLVEKTEGYSGSDIRLVCKEAAMQPLRRLMSVLEGRQEEVPEDELPEVGPVTTEDIELALRNTRPSAHLHVHRYEKFNQDYGSHVLS

SEQ ID NO: 7978 - protein, 403 aa, Brachypodium distachyon
MAAGDEPSITRWSFEDFERYYDARLGIRGEPKGDGNDVDDERPLGSGSAGSSPAAFHANGGADLAVFEQFERLNRKVGLHNGAMEARPLQKSLLPPFESAETRNLAETLLRDIIHGSPDVKWESIKGLETAKRLLKEAVVMPIKYPKYFTGLLSPWKGILLFGPPGTGKTMLAKAVATECKTTFFNISASSIVSKWRGDSEKLVKVLFELARHHAPSTIFLDEIDAIISQRGEARSEHEASRRLKTELLIQMDGLTKTRELVFVLAATNLPWELDAAMLRRLEKRILVPLPEPEARHAMFEEFLPSTPVTMGIPYDVLVENTEGYSGSDIRLVCKEAAMQPLRRLMAVLEGTQEEVPEDELPEVGPIAAEDIELALRNTRPSAHLHTHKYEKFNQDYGSHVIS

SEQ ID NO: 7979 - protein, 395 aa, Triticum aestivum
MAAGDEPSVTRWSFQDFERYYDAGLGICRQPQGDGDDAPPGSGSADTAHANGGADLSVFEQFERLDRNVELRNGSMDAGPPQKSLLPSFESAETRNLAETLLRDIIRGSPDVKWESIKGLETAKRLLKEAVVMPIKYPKYFTGLLSPWKGILLFGPPGTGKTMLAKAVATECKTTFFNISASSIVSKWRGDSEKLVKVLFELARHHAPSTIFLDEIDAIISQRGEARSEHEASRRLKTELLIQMDGLTKTDELVFVLAATNLPWELDAAMLRRLEKRILVPLPEAEARHAMFEEFLPSTPDTMEIPYDVLVENTEGYSGSDIRLVCKEAAMQPLRRLMAVLEGRQEEMPEDELPEVGPIAAEDIELALRNTRPSAHLHAHRYEKFNQDYGSHVIG

SEQ ID NO: 7980 - protein, 399 aa, Secale cereale
MAAGDEPSVTRWSFQDFERYYDAGLGICRQPQGDGDNDGDDAPPGSGSADTTHANGGADLSVFEHFQQMDRNVELRNGAMDAGPPQKSLLPSFESAETRNLAETLLRDIIHGSPDVKWESIKGLETAKRLLKEAVVMPIKYPKYFTGLLSPWKGILLFGPPGTGKTMLAKAVATECKTTFFNISASSIVSKWRGDSEKLVKVLFELARHHAPSTIFLDEIDAIISQRGEARSEHEASRRLKTELLIQMDGLTKTDELVFVLAATNLPWELDAAMLRRLEKRILVPLPEPEARHAMFEEFLPSTPDTMEIPYDVLVENTEGYSGSDIRLVCKEAAMQPLRRLMAVLEGRQEEIPEDELPEVGPIAAEDIELALRNTRPSAHLHAHRYEKFNQDYGSHVIG

SEQ ID NO: 7981 - protein, 399 aa, Avena sativa
MAAADEPSITRWSFEDFERYYDAGLGIRHAPKGDGDDDDDEAPLGSGFADVARANGGADLAVFEQYGRLDRNIEFRNGAMDAGPPQKSLLPSFESAETRNLAETLLRDIIRGSPDVKWESIKGLETAKRLLKEAVVMPIKYPKYFTGLLSPWKGILLFGPPGTGKTMLAKAVATECNTTFFNISASSIVSKWRGDSEKLVKVLFELARHHAPSTIFLDEIDAIISQRGEARSEHEASRRLKTELLIQMDGLTKTDELVFVLAATNLPWELDAAMLRRLEKRILVPLPESEARQAMFEEFLPSSPNTMEVPYDILVENTEGYSGSDIRLVCKEAAMQPLRRIMAALEGAQELVPEDDLPEVGPVTAEDIELALRNTRPSAHLHAHRYEKFNQDYGSHVLS

SEQ ID NO: 7982 - protein, 400 aa, Hordeum vulgare
MAAGDEPSVTRWSFQDFERYYDAGLGICRQPKGDGDGDSNDDAPPGSGAADAAHANGGADLSVFEHYERMDRNVELRNGAMDAGPPQKSLLPSFESAETRNLAETLLRDIIRGSPDVKWESIKGLETAKRLLKEAVVMPIKYPKYFTGLLSPWKGILLFGPPGTGKTMLAKAVATECKTTFFNISASSIVSKWRGDSEKLVKVLFELARHHAPSTIFLDEIDAIISQRGEARSEHEASRRLKTELLIQMDGLTKTDELVFVLAATNLPWELDAAMLRRLEKRILVPLPEAEARHAMFEEFLPLTRDTMEIPYDALVENTEGYSGSDIRLVCKEAAMQPLRRLMAVLEGRQEEIPEDELPEVGPIATEDIELALRNTRPSAHLHAHRYEKFNQDYGSHVLS

SEQ ID NO: 7983 - protein, 97 aa, Zea mays
MADGEPSLTRWTFEDFVVHYEARFGLRREADGDGDGDGGDAPCRVDPIMGQPPRHCPRQRRRGPRRLRAVRADGEEGGDKQWSYRGWSTAEISTSFI

SEQ ID NO: 7984 - protein, 70 aa, Amorphophallus konjac
MGFWVTTLIFVLAGFIASLCALICCSRGPSTNLFHLTLIITAAVCCWMMWAIVYLAQMKPLIVPILSEGE

SEQ ID NO: 7985 - protein, 784 aa, Oryza sativa
MTPARRMPPVIGRNGVAYESPSAQLPLTQADMLDSHHLQQALQQQYFDQIPVTTTAAADSGDNMLHGRADAGGLVDEFESKSCSENVDGAGDGLSGDDQDPNQRPRKKRYHRHTQHQIQEMEAFFKECPHPDDKQRKELSRELGLEPLQVKFWFQNKRTQMKNQHERHENAQLRAENDKLRAENMRYKEALSSASCPNCGGPAALGEMSFDEHHLRVENARLRDEIDRISGIAAKHVGKPPIVSFPVLSSPLAVAAARSPLDLAGAYGVVTPGLDMFGGAGDLLRGVHPLDADKPMIVELAVAAMDELVQMAQLDEPLWSSSSEPAAALLDEEEYARMFPRGLGPKQYGLKSEASRHGAVVIMTHSNLVEILMDVNQFATVFSSIVSRASTHEVLSTGVAGNYNGALQVMSMEFQVPSPLVPTRESYFVRYCKNNSDGTWAVVDVSLDSLRPSPVQKCRRRPSGCLIQEMPNGYSKVTWVEHVEVDDSSVHNIYKPLVNSGLAFGAKRWVGTLDRQCERLASAMASNIPNGDLGVITSVEGRKSMLKLAERMVASFCGGVTASVAHQWTTLSGSGAEDVRVMTRKSVDDPGRPPGIVLNAATSFWLPVPPAAVFDFLRDETSRSEWDILSNGGAVQEMAHIANGRDHGNSVSLLRVNSANSNQSNMLILQESCTDASGSYVVYAPVDIVAMNVVLNGGDPDYVALLPSGFAILPDGPSGNAQAAVGENGSGSGGGSLLTVAFQILVDSVPTAKLSLGSVATVNSLIACTVERIKAAVCRDSNPQ

SEQ ID NO: 7986 - protein, 781 aa, Sorghum bicolor
MTPARRMPAMIGRNGMAFGSSSALSLSQADLLDSHHLQQAFQQQLFDQIPATAVDSSDNIIHGRSDTLVDEFESKSCSENPDGTSGDDGQEDPNQRPNKKKRYHRHTQHQIQEMEAFFKECPHPDDKQRKELSRELGLEPLQVKFWFQNKRTQMKNQHERQENAQLRAENDKLRAENMRYKEALGTASCPSCGGPAALGEMSFDEHHLRLENARLRDEIDRISGIAAKHVGKPMVSFPVLSSPLAAAAARSPLDLAGAYGVQPGGLGADHLFGVGAGAGDLLRSVSTGQLDADKPMIVELAVAAMDELLRMARLDAPLWGGGVAGVQLDEEEYGRMFPGGLGPRQYGLRPEASRDNAVVIMTRDSLVEILMDANRFAAVFSSIVSRASTHEVLSTGVAGSYNGALQVMSMEFQVPSPLVPTRESYFVRYCKNNPDGTWAVVDVSLDSLRPSPVMKCRRRPSGCLIQEMPNGYSKVTWVEHVEVDDRSVHNLYRPLVNSGLAFGAKRWVGTLDRQCERLASAMASNIPNGDLGVITSIEGRKSMLKLAERMVASFCGGVTASAAHQWTTLSGSGAEDVRVMTRKSVDDPGRPPGIVLNAATSFWLPVPPKRVFDFLRDETSRSEWDILSNGGAVQEMAHIANGRDHGNCVSLLRVNSANSNQSNMLILQESCTDASGSYVVYAPVDVVAMNVVLNGGDPDYVALLPSGFAILPDGPPGMAPHGEGAALETGGGSLLTVAFQILVDSVPTAKLSLGSVATVNSLIACTVERIKAAVCVEGNPQ

SEQ ID NO: 7987 - protein, 632 aa, Panicum virgatum
NKRTQMKNQHERQENAQLRAENDKLRAENMRYKEALSTASCPSCGGPAALGEMSFDEHHLRLENARLRDEIDRISGIAAKHVGKPMVSFPVLSSPLAAAAARSPLDVVGAFGSAGLGPVDPLFGVGTGAGELLRSVSTGQLDADKPMIVELAVAAMDELLRMARLDAPLWSTGAAGAQLDEEEYGRMFPGGLGPRQYGLRPEASRDGAVVIMTRDSLVEILMDVNRFAAVFSSIVSRASTHEVLSTGVAGSYNGALQVMSMEFQVPSPLVPTRESYFARYCKNNPDGTWAVVDVSLDSLRPNPVLKCRRRPSGCLIQEMPNGYSKVTWVEHVEVDDRSVHNLYRPLVNSGLAFGAKRWVGTLDRQCERLASAMASNIPNGDLGVITSIEGRKSMLKLAERMVASFCGGVTASAAHQWTTLSGSGAEDVRVMTRKSVDDPGRPPGIVLNAATSFWLPVPPKRVFDFLRDETSRSEWDILSNGGAVQEMAHIANGRDHGNCVSLLRVNSANSNQSNMLILQESCTDASGSYVVYAPVDVVAMNVVLNGGDPDYVALLPSGFAILPDGPPGASPHGEISAGLEAGGGSLLTVAFQILVDSVPTAKLSLGSVATVNSLIACTVERIKAAVCAEGPQ

SEQ ID NO: 7988 - protein, 803 aa, Zea mays
MIPARHMPPMIVRNSAAAYGSSSALSLGQPNLLLDNQQLQLLQQQHLLDQIPATTAESGDNMGRGGGGVSDPLLGDEFESKSGSENVDGGVSVDELQDPNQRPSKKKRYHRHTQHQIQELEAFFKECPHPDDKQRKELSRELGLEPLQVKFWFQNKRTQMKNHHERQENSQLRSENEKLRAENMRYKEALSSASCPSCGGPAALGEMSFDEHHLRVENARLREEVDRISSIAAKYVGRPMVPFPVLSSPLAGAGARAPALPPLDMAPPYGAAADMFGGGGVVAAAGAAGAGDLLLRGAAVQSDADKPMIVELAVAAMEELVRMAQLDEPLWNAPAGLDGSAEEETLNEEEYARLFPGGLGPKPYGLNSEASRDSAVVIMTHANLVEILMDVNQYAAVFSSIVSRAATLEVLSTGVAGNYNGALQVMSVEFQVPSPLVPTRESYFVRYCKQNADGTWAVVDVSLDGLRPGAVLKCRRRPSGCLIQEMPNGYSKVTWVEHVEVDDRSVHSIYKLLVSSGLAFGARRWVGTLDRQCERLASVMASNIPTSDIGVITSAEGRKSMLKLAERMVMSFCGGVTASAAHQWTTLSGSGAEDVRVMTRKSVDDPGRPPGIVLNAATSFWLPVPPKRVFDFLRDESSRSEWDILSNGGVVQEMAHIANGRDHGNCVSLLRVNSTNSNQSSMLILQESCTDMSGSYVIYAPVDVVAMNVVLNGGDPDYVALLPSGFAILPDGPSSGSSSMLQGDGGVGSGGSLLTVAFQILVDSVPTAKISLGSVATVNSLIACTVERIKAAVISGQSNPQQQ

SEQ ID NO: 7989 - protein, 145 aa, Secale cereale
MRCLPFLHGDAKEEDRRTGPSAAMSASVRSFSTESTERGDRSDLNSINVSDMSAESIRRTHYPSFTDRPANLRVFTFPELKAATATSAAPSWSARAASAASTGASSRAPTTTPTSASRSPSSSSTAREVQGAEGMVNRDERAWDC

SEQ ID NO: 7990 - protein, 135 aa, Secale cereale
MRCLPFLHGDAKEEDRRTGPSAAMSASVRSFSTESTERGDRSDLNSINVSDMSAESIRRTHYPSFTDRPANLRVFTFPELKAATRNFSRSLMVGEGGFGCVYRGVIKGSDDDPNERVEIAVKQLTARESRGRRNG

SEQ ID NO: 7991 - protein, 156 aa, Brachypodium distachyon
MGCLAFLHGESKEERPAPKSASVRSFSTTSTEREVPSGSDLTSMNISDMSAESIRRTQYPSFTDRPSNLRVFTFSELKNATRNFSRSLMVGEGGFGCVYRGIIKNSDEPNERIEIAVKQLNRKGVQASFFTILYCSTVVWQYCFQGLLLKLGRRNG

SEQ ID NO: 7992 - protein, 157 aa, Sorghum bicolor
MKCLPFLHGDAKEKDPVTKSASVRSMSTTSTERDVRSGSDFTSLNVSDMSAESIRRTQYPSFTDRPPNLRVFSFAELKSATRNFSRSLMVGEGGFGCVYRGVIKNSDEPSERIEIAVKQLNRKGLQASVFTILCFLFFFPRICMRTAYLCIRGRRSG

SEQ ID NO: 7993 - protein, 349 aa, Pennisetum glaucum
AELKSATRNFSRSLMVGEGGFGCVYRGVIKTSDEPNERIEIAVKQLNRKGLQGQKEWLTEMNVLGIVDHPNLVKLIGYCAEDDERGVQRLLVYEYMPNGSVDDHLSSRSASTLSWPMRLKVALDSARGLKYLHEEMEFQVIFRDLKTSNILLDENWNAKLSDFGLARHGPTEGLTHVSTAVVGTLGYAAPEYMQTGRLTAKSDIWSYGVLLYELITGRRPIDRNRPKSEQKLLEWVKPYVGDKKRFPIIIDPRLEGHYNLKSMLKLSSVANRCLVRMPKTRPKMSEVYEMIQKVVDSVETGPPQPPLHYHGSSAAASGAGGGKRTKKGPLKRRLQELKLWWRGVEALRW

SEQ ID NO: 7994 - protein, 112 aa, Brachypodium distachyon
MVKPELLEERIFNSITWAPRIWRPWDNPFDCRVLFRSKDIRGGQFVRPILIFRTKRYWILFRIGPERRRKAEMPTDLCLFSNSPEPIVPVFGTSSAKVTEWVSHQSNPFDKS

SEQ ID NO: 7995 - protein, 803 aa, Secale cereale
MDFSTPSKPAPTPTTTPRRKSKPVPYAPPPPASPATPSAVRRSSRLLDTPTKDLSEAALFETPAKPKPAPAPTLKRKRAAPSPSPKTPSRAEPKPKRQRRAPTKRAFYRKVVYDGGEFAAGDDVYVKRLEGAESDAEDPEEPEDCRVCFRAGGGVMVECDACLGGFHLRCVRPPLRRVPEGDWACPYCEAEREGRAMDRPKPPVGKKIKRTAKEKLLDSDLWAARIESLRREPDGAFWAKVRWYTIPEETAAGRQPHNLRRELYRTNALGDIEMESIVRHCYVMSPKEYRDAANDGDDVFYCEYEYDVHWHNFKRLADIDDEPETKEDPSDEPYNAANDYNSDTDEDSEYDEEDEPVARCSARKNQPNDKILAANSWKGRIYGLQKIGIRKIPEHVRCHQKTALEKAKATLLLATLPKSLPCRDKEMEEISTFVKDAICNDHCLGRCLYIHGVPGTGKTMSVLAVMRRLRSEFDSGALRPYCFIEINGLKLASPENIYKVIYEQLSGHRVGWKKALHYLTEHFSDGKKIGKQANQPIVLLIDELDLLLTRNQSVLYNILDWPTKPNSNLVIIGIANTMDLPEKLLPRISSRMGIQRLCFGPYNYRQLQEIITSRLKGINAFEDQAIEFASRKVAAMSGDARRALEICRRAAEFADYRVKQFQQAEQTPSSANTGNGFVCMGDIEDAIQEVFQAPHIQVMKNCPKFGKVILAAMVHELYRSGLGEVLFDKLAATVFSWCHVNRELLPGYDTLLKICCKLGESKIVLCEEGTKHKLQKLQLNYPSDDVTFALKESPDLPWLSKYL

SEQ ID NO: 7996 - protein, 818 aa, Brachypodium distachyon
MDLSATPTRSKSKPRSTPSKTIAASAAAQMDLSTPSKPTTRRKSKSVSSPPSIAPATPSTVRRSRRLLETPTRRLLETPTKDLVETPAKPAPAPTLKRKRAAPSPKTPIQAEPKRQRRLPKKKAHYRKVVYDGGEFAAGDDVYVKRREGAESDEEEPEEEECRVCFHAGGEVMVECDACLGGFHLRCVRPPLRRVPEGDWACPYCEAERAGRAIERPKQPVGKSIRRTAKEKLLSSDLWAARIESLWREPDGTFWAKVRWYTIPEETAAGRQPHNLRRELYRTNDLADIEMETILRHCYVMSPKEFRDASNEGDDVFYCEYEYDVHWHNFKRLADIDDEPETQEDPSDEPYNAGNDYNSDTDEDSEFEEEDGPAKRCSARKNQSHQFAANSRKGRIYGLQKIGIRKIPEHVRCHQKTDLEKAKATLLLATLPKSLPCRDKEMEEISTFVKDAICNDQCLGRCLYIHGVPGTGKTMSVLAVMRRLRSELDSGALRPYCFIEINGLKLASPENIYKVIYEQLSGHRVGWKKALHYLTEHFSDGTKIGKQTSQPIILLIDELDLLLTRNQSVLYNVLDWPTKPNSNLVVIGIANTMDLPEKLLPRISSRMGIQRLCFGPYNYRQLQEIITSRLKGIDAFEDQAIEFASRKVAAMSGDARRALEICRRAAEFADYRIKQFQQSGQAPSSANRGNGVVCMGDVEDAIQEVFQAPHIQVMKNCPKFGKIILAAMVHELYRSGLGEVLFDKLAATVLSWCHVNRELLPGYDTLLKICCKLGESKIVLCEEGTKHKFQKVQLNYPSDDVTFALKESPDLPWLSKYL

SEQ ID NO: 7997 - protein, 422 aa, Secale cereale
YGLQKIGIRKIPEHVRCHQKTALEKAKATLLLATLPKSLPCRDKEMEEISTFVKDAICNDHCLGRCLYIHGVPGTGKTMSVLAVMRRLRSEFDSGALRPYCFIEINGLKLASPENIYKVIYEQLSGHRVGWKKALHYLTEHFSDGKKIGKQANQPIVLLIDELDLLLTRNQSVLYNILDWPTKPNSNLVIIGIANTMDLPEKLLPRISSRMGIQRLCFGPYNYRQLQEIITSRLKGINAFEDQAIEFASRKVAAMSGDARRALEICRRAAEFADYRVKQFQQAEQTPSSANTGNGFVCMGDIEDAIQEVFQAPHIQVMKNCPKFGKVILAAMVHELYRSGLGEVLFDKLAATVFSWCHVNRELLPGYDTLLKICCKLGESKIVLCEEGTKHKLQKLQLNYPSDDVTFALKESPDLPWLSKYL

SEQ ID NO: 7998 - protein, 810 aa, Zea mays
MDVAATPSRSKSKPRSSLVNPVAAPAESRMDLCTPSKPTPRRNSKSTASPAPMSPSTPYTVRRSRRLLETPTKAALEVQVKATLTPTSKGKRAAPSPKTPAQHEPKRQKRHPRKRAYYRKVVYDGGEFEVGDDVYVKRREAAESDAEDPEEEECRVCFRTGGGVMVECDACLGGFHLRCVRPPLRRVPEGDWACPYCEAERAGKVVERPRPPEGKRIVRTAKEKLLSSDLWAARIESLWREPDGTFWAKVRWYIIPEETAAGRQLHNLRRELYRTNDLADIEMETILRHCSIMCPKDFRDANDGGDDVFYCEYEYDIHWHNFKRLADIGDEPETKEDPSDEPYNASDDYNSDTDEDSEYDEVEEPTSSFSARGNQSHELAANSRKGRIYGLQKIGIRKIPEHVRCHQKTELEKAKATLLLATLPKSLPCRDKEMEEISIFVKDAICNDQCLGRCLYIHGVPGTGKTMSVLAVMRRLRSEFDSGTLRPYCFIEINGLKLASPENIYKVVYEQLSGHRVGWKKALHYLTEHFSGGTKIGKQANQPIILLIDELDLLLTRNQSVLYNILDWPTKPYSNLVVIGIANTMDLPEKLLPRISSRMGIQRLCFGPYNYRQLQEIITSRLKGIDAFEEQAIEFASRKVAAMSGDARRALEICRRAAEFADYRVKQSRQSAQNTVSANKGDGVVSMGDIEAAIQEVFQAPHIQVMKNCPKFGKVILVAIVHELYKSGLGEIMFDKLATTVFSWCRAHRELLPGYDTLLKICCKLGESKIILCEEGTKHKLQKVQLNYPSDDVTFALKESPDLPWLSKYL

SEQ ID NO: 7999 - protein, 810 aa, Sorghum bicolor
MDLAATPSRSKSKPRSSPAKPAAAAAKSRMDLCTPSKPTPRRKSKSTASPAPMSPATPSTIRRSRRLLETPTKAALEVQVKATPTPTSKAKRAAPSPKTPAQREPKRQKRHPRKRAYYRKVVYDGGEFEVGDDVYVKRREAAESDGEDPEVEECRVCFRTGGGVMVECDACLGGFHLRCVRPPLRRVPEGDWACPYCEAERAGKLVERPRPPEGKRIVRTSKEKLLSGDLWAARIESLWREPDGTFWAKIRWYIIPEETAAGRQPHNLRRELYRTNDLGDIEMETILRHCSVMSPKDFRDANDGGDDVFYCEYEYDIHWHNFKRLADIDDELETKEDPNDEPYNAGDDYNSDSDEDSEYDEEEEPTSSFSARRNQSHELAANSRKGRIYGLQKIGIRKIPEHVRCHQKTELEKAKATLLLATLPKSLPCRDKEMEEISIFVKDAICNDQCLGRCLYIHGVPGTGKTMSVLAVMRRLRSEFDSGTLRPYCFIEINGLKLASPENIYKVVYEQLSGHRVGWKKALHYLTEHFSGGTKIGKQANQPIILLIDELDLLLTRNQSVLYNILDWPTKPNSNLVVIGIANTMDLPEKLLPRISSRMGIQRLCFGPYNYRQLQEIITSRLKGIDAFEEQAIEFASRKVAAMSGDARRALEICRRAAEFADYRVKQSRQSAQSTVSANKGDGVVSMGDIEAAIQEVFQAPHIQVMKNCPKFGKVILVALVHELYKSGLGEIMFDKLATTVFSWCLANREVVPGYDTLVKICCKLGESKIILCEEGSKHKLQKLQLNYPSDDVTFALKESTDLPWISKYL

SEQ ID NO: 8000 - protein, 812 aa, Oryza sativa
MDLSATPSRSKSGLRSSPRKPVAAPAVAQMDLSTPSKPTPRRKPKAPPVAAPMSPVTPSSVRRSSRLLETPTKVTSETPVKPTPTPKRKRAAPSPSPKTPTQSEPKRQRQRQRQQPKKPKKRAYYRKVVYDGGEFAAGDDVYVKRRDGAESDAEDPEAEECRVCFRAGAAVMVECDVCLGGFHLRCVRPPLRRVPEGDWACPYCEAERAGKAIERPKPPEGKRIVRTAKEKLLSSDLWAARIESLWREPDGIFWAKVRWYIIPEETAAGRQPHNLRRELYRTNDLADIEMETILRHCYVMSPKEFKDASDQGDDVFYCEYEYDIHWHNFKRLADIDDEPETKEDPGDEPYNAGNDYVSDSDEDSEYDEEEEPTKCSSARTHQSHALAANLRKGRTYGLQKIGIRKIPEHVRCHQKTNLEKAKATLLLATLPKSLPCRDKEMEEISAFVKDAICNDQCLGRCLYIHGVPGTGKTMSVLAVMRRLRSELDSGNLRPYSFIEINGLKLASPENIYKVIYEQLSGHRVGWKKALHYLTEHFSGGTKIGKQANQPIILLIDELDLLLTRNQSVLYNILDWPTRPNSNLVVIGIANTMDLPEKLLPRISSRMGIQRLCFGPYNYRQLQEIITSRLKGIDAFEDQAIEFASRKVAAMSGDARRALEICRRAAEFADYRVKQSGHTSVNRGKNVVCMGDIEAAIQEVFQAPHIQVMKNCPKFGKIILVAMVHELYRSGLGEVMFDKLAATVLSWCHVNRELLPGYDTLLKICCKLGEGKIILCEEGTKHKLQKLQLNYPSDDVTFALKESPDIPWLSKYL

SEQ ID NO: 8001 - protein, 307 aa, Panicum virgatum
IAGNDYNSDTDEDSEYDEEEEPKSCFSARRNQSHELAANSRKGRTYGLQKIGIRKIPEHVRCHQKTELEKAKATLLLATLPKSLPCRDKEMEEISTFVKDAICNDQCLGRCLYIHGVPGTGKTMSVLAVMRRLRSEFNSGTLNPYCFIEINGLKLASPENIYKVIYEQLSGHRVGWKKALHYLTEHFSGVSKIGKQANQPIILLIDELDLLLTRNQSVLYNILDWPTKPNSNLVVIGIANTMDLPEKLLPRISSRMGIQRLCFGPYNFRQLQEIITSRLKGIDAFEEQAIEFASRKVAAMSVMLGEL

SEQ ID NO: 8002 - protein, 88 aa, Panicum virgatum
MDQILELREKEQKLAKENAMLRDQCKALPLLELNDKGHMDAAAAGGEEEEAADDGRMEDVETELAIGIGTRWPPRSIMDRMTSKHQDS

SEQ ID NO: 8003 - protein, 163 aa, Panicum virgatum
MYPAKPSEPAAAPVTGVPVGVPGGGQGQWSSGLLDCFDDCGLCCLTCWCPCITFGRVAEIVDRGATSCGTSGALYALLAYLTGCQWIYSCTYRAKMRAQFGLPENPCCDCCVHFCCEPCALCQQYKELKARGFDPDLGWELNAQRANAAAMPMYPPAAQGMGR

SEQ ID NO: 8004 - protein, 158 aa, Sorghum bicolor
MYPSKPSEQAGAAPVTGIPVGGPAAAASQWSSGLFDCFDDCGLCCLTCWCPCITFGRMAEIVDRGATSCGTAGALYTLLAYFTGCQWIYSCTYRAKMRAQFGLPDTPCCDCCVHFCCEPCALCQQYKELKARGYDPVLGWDQQGAAAMHPPAAQGMGR

SEQ ID NO: 8005 - protein, 356 aa, Sorghum bicolor
MYPAKPTAAAASAPVVGMAPPVTGVPISSPGPVAATEWSSGLCACFDDCGLCCLTCWCPCITFGRIAEIVDRGATSCGAAGAIYTVLACFTGCQWIYSCTYRSKMRAQLGLPDVGCCDCCVHFCCEPCALCQQYRELKARGFHPDLGWDVNAQKAAANAAAGIASRLAKKPRSRSIALSIVRVRAQRSEKAGQLDVDDMYPSKPSEQAGAAPVTGIPVGGPAAAASQWSSGLFDCFDDCGLCCLTCWCPCITFGRMAEIVDRGATSCGTAGALYTLLAYFTGCQWIYSCTYRAKMRAQFGLPDTPCCDCCVHFCCEPCALCQQYKELKARGYDPVLGWDQQGAAAMHPPAAQGMGR

SEQ ID NO: 8006 - protein, 130 aa, Setaria italica
MPGITGYDLTGYDLLKKVKESSSLRDIPVLIMSSENIPSRINRCLEEGADEFYLKPVRLSDMSKLKPHILKSRCKEHYQEQHQQSDSNSNECSNPTNDSSSSSSDNSNSRKREAEDNEEILPQRNRSRHS

SEQ ID NO: 8007 - protein, 120 aa, Setaria italica
MYMLVLFKQESSSLRDIPVLIMSSENIPSRINRCLEEGADEFYLKPVRLSDMSKLKPHILKSRCKEHYQEQHQQSDSNSNECSNPTNDSSSSSSDNSNSRKREAEDNEEILPQRNRSRHS

SEQ ID NO: 8008 - protein, 162 aa, Pennisetum glaucum
HDESPPPPPPAAVSVLHPAAAADHLEAAAAVNLIITDYCMPGMTGYDLLKKIKESSSLRDIPVVIMSSENIPSRINRCLEEGADEFFLKPVRLSDMSKLKPHILKSRCKEHYHEEQHQQSDSNSNECSNPTNDSSSSDNSSRKRKAQDNEEILPQRNRSRHN

SEQ ID NO: 8009 - protein, 612 aa, Panicum virgatum
MDAEAGVVGADQLPRRQYYMNLLLLAYQSFGVVYGDLSTSPLYVYKSTFAGKLRQYQDEETVFGVLSLIFWTFTLIPLLKYVTIVLSADDNGEGGPFALYSLLCRHAKLSLLPNQQAADEELSTYYRNGFAPRNGSAPWLRRFLEKHKKMRTVLLLIVLCGASMVIGDGILTPAISVLSSMSGLQVRATGLEHRSVVLLSCIVLVGLFALQHRGTQKVAFLFAPIVIIWLFSIGGIGLYNILHWNPNIYQALSPYYMVKFFRKTGKDGWIALGGILLSMTGSEAMFADLGHFTSASVRVAFVTVIYPCLILQYMGHAAFLSKNTFHMTTGFYDTIPEPVFWPVFVVATLAAVVGSQAVISATFSIVKQCHALGCFPRVKVVHTSRWIYGQIYIPEINWILMVLCVAVTVAFRDTTLIGNAYGIACMTVMLVTTFLMALIVIFVWQRNIIFALIFLAFFGSIEAVYLSSSLMKVPQGGWVPLVLAFIFMSVMYIWHYGLRRKYQFDLQNKVSMRSILSLGPSLGIVRVPGIGLIYTELVTGVPSIFSHFVTNLPAFHEVLVFLCVKSVPVPYVSPDERYLVGRIGPKEYRMYRCIVRYGYKDVQRDDDILRTC

SEQ ID NO: 8010 - protein, 108 aa, Zea mays
MTEEREHALSDLEVVPGRVAAAVLVGVLAESIIAAAGVRVGRALPAPLVVAGQTQAAAALDVVELRQLVEPAGNTQALAEAGDEHDGGLGVRLAHLVPPVVRLLLGHL

SEQ ID NO: 8011 - protein, 215 aa, Sorghum bicolor
MDRKSKSTKGSAASSAAASMAALAAAAAAGDSSADPGAEDNVPAKMAAVGDVSSSSPVAARRSVAAAGGAASSSSPVPAAARRGAAAAAAASVAAGGGGGGGPRCQAERCNANLMTDEKPYNRRHKVCEAHSKAPVVLVAGLRQRFCQQCSRFHELSEFDDIKRSCRLRLAGHNERRRKSSADAHGGGGAGAGAGNGFRQHADQNGPAGNHFQIR

SEQ ID NO: 8012 - protein, 382 aa, Setaria italica
EEGKSKCSWVSLDDITNCLIRGDSEKSHHHQRVAELQRLRSIFATSERQWIEAQVENAKQQAILSILKAQVSSDEAHIHRDIHSLRRKGSELAGELSTLSQKVQAFVSETIPCLCSELAQLQGTYILQGDYDLKVMRQEYYINRQKTFINHLVNQLARHQFLKIACQLERKNIASAYSLLRVIESELQSYLSAVNTRLGHYNSLIQAASDVREQGAIDDRDTFLHAVRDLLCIHSNVQATVPTYMSAHALVQQISALQSDLLSLQSELENTLPADRKRFINELCTLIQTVEQLLFASSTTAEPILTPWPLMRALDDMENANAQVEVSVEEVTKARTQKIKIFENRAHEVGRERQIFVDFFCNPERLKNQVRELTSRVKALQD

SEQ ID NO: 8013 - protein, 254 aa, Pennisetum glaucum
GDYDLKVMRQEYYINRQKTFINHLVNQLARHQFLKIACQLERKNIASAYSLLRVIESELQSYLSAVNTRLGHCNSLIQAASDVREQGAIDDRDTFLHAVRDLLCVHSNVQATVPTYMSAHALVQQISALQSDLLSLQSELENTLPADRKRCINELCTLIQTVEQLLFASSTTAEPILTPWPLMRALDDMENANAQVEVSVEEVTKARTQKIKIFENRAHEVGRERQIFIDFFCNPERLKNQVRELTSRVKALQD

SEQ ID NO: 8014 - protein, 359 aa, Secale cereale
MSGAALCAALTELGFDGEDPLDADALEWPFQYEEARPLLAWICSCLRPSNVLSPSHLSQYEQLVEEGRLLEGEDLDSAFDSISAFSSKKDNQEAVFEAEETILDIREAKLAYRAEVFELQRQLARQQAQFDMLAGQASSLIQGRRARVSAMSAVSVQLISLDEILSSRNLEMNAVLGRITATTQELAHYHSGDEDSIYLAYSDFHPYVIGDLACTKELNRWFSKQFEKGPFRLVAEEGKSKCSWVSLDDITNGLTRGDSEKSHHHQRVAELQRLRSIFATSERQWIEAQVENAKQQAILQILKSQVSSDEAHIHRDIHSLRRKSSELAGELSTLTQKVQPFISETIPCLCSELAQLQGT

SEQ ID NO: 8015 - protein, 486 aa, Triticum aestivum
MLAGQASSLIQGRRARVSAMSAVSVQLISLDEILSSRNLEMNAVLGRITATTQELAHYHSGDEDSIYLAYSDFHPYVIGDLACTKELNRWFSKQFEKGPFRLVAEEGKSKCSWVSLDDITNGLTRGDSEKSHHHQRVAELQRLRSIFATSERQWIEAQVENAKQQAILQILKSQVSSDEAHIHQDIHSLRRKSSELAGELSTLTQKVQPFISETIPCLCSELAQLQGTYILQGDYDLKVMRQEYYINRQKTFINHLVNQLARHQFLKIACQLERKHIASAHALLRVIESELHSYLSAVNTRLGHCNSLIQAASEVREQGAIDDRDTFLHAVRDLLCIHSNSQAAVPTYMSAHALVQQISALQSDLLSLQSELENTLPADRKRCINELCTLIQTVEQLLFASSTTAEPVLTPWPLMRALDDMENANAQVEVAVEEVTKARTQKIKIFENRAHEVGRERQVFVDFFSNHERLKNQVRELTSRVKALQE

SEQ ID NO: 8016 - protein, 855 aa, Sorghum bicolor
MMDTRRHSVSVDVPLSRTLVQLKRVRSLRDPATNSMSKYASPSDHMIWETASSNGVTLDLGRSKSSAAMSRVGSPCMSASEARSVGSRRSTLGHGTEDTRLRSNDVVGSNFSGCGISYCWSGASKYRELYSDSDGPDQPLLSTDGTEAAFQGNVPYTETPRCLSQKFRPRSFSELIGLNVVAQSLLYSSCKGKVAPMYLFHGPRGTGKTSTARIFAAALNCVSLEEQRPCGFCKECVILFSGKSRDVKELDAAKMDRLGRVKALLKSASLVPYSSRFKVFIIDECHLLQEDAWSAILKSLDEPYRHTVYIMITSDIESLPRTSITHCQKFHFPKIKVADIVYRLERICIEEGLEFDHDGLYFIAAKSNGSLRDSEIMLDQLSLLGKKITISLVHELVGSVSDDELIELLDLALSSDTTNTVRRARELMGSAIDPLQLVSQLANLIMDILSGRCQSAVTEVSKSFLGRYALSEIGIKKLRHALKILSETEKQLRTSRNQATWVTVALLQFSTNEPNLAAEPNDMHAHSVTGYTDDWVSKVHSSANFCQACNSSKSNCSERHCRRLKLENIWRRAIGKCRSRSAKSFLRKEGFLSSVHVTEELAIAEVGFGHPDHLSRAEKMQSLIECSLQHVLGCNVEIRFKLVPCPVRKDARLKRQSFSFLNCSGRKQELSDSVVTDEDEVVRPGARETPLKGYTSSQQESPYTMQRVDSKPTVHGCEDDARSTLTSNRSMTDDLTRTCRSETNYSKGVSEHGHFDSIQEPDLQPNCFSRTLKLQKKLLSSGAAHTICLRIQPHNKMDFLPKKEFDTYFCAYEPYEQCSRSNSRATYSSRDDDLWSKNSRFGSNLLCWRAPKQSM

SEQ ID NO: 8017 - protein, 846 aa, Zea mays
MTDMRRHSVDVPLSRTLVQLKRLRSLRDPATNSMGKFASPADHMVWETASSNGVALELGRSKPSAAMSRVGSPCMSASEARSGHGTEDTRLRSNDVVGSNFSGCGISYCWSGASKCRELYSDSDGPDQPLLSTDGTEAAFQGNVPYTETPRCLSQKFRPRSFSELVGLNVVAQSLLYSCCKGKVAPMYLFHGPRGTGKTSTARIFAAALNCVSLEEQRPCGFCKECVILFSGKGRDVKELDVAKMGRLGRVKALLKSASLVPYSSRFKVFIIDECHLLQEDAWSAILKSLDEPYRHTVYIMITSDIESLPRASITRCQKFHFPKIKVADIVYRLEKICIGEGLEFDHDGLYFIAAKSSGSLRDSEVMLDQLSLLGKKITISLVHELVGSVSDDELIELLDLALSSDTTNTVRRARELMGSAIDPLQLVSQLANLIMDILSGRCQSAVSEVSKSFLGRYALSEVGIKKLRHALKILSETEKQLRTSRNQATWVTVALLQFGTNEPNLIAEPNDMHSHSVTGYTDDWVSKVHSNTNFCQACNSSKSNCSERHCRRLKLENIWRRAIGKCRSRSAKSFLRKEGFLSSVHVTEELAIAEVGFGHPDHLSRAEKMQSLIECSLQHVLGCNVEIRFKLVPCPVRKDARLKRHSFSFLSCSGRKQELSDSVVTDEDEAVRPGARETPLKGYTSSQQESPYTMQRVDSKPTAYGCEDDGRSTLTSNRSMTDDMTRTCRSETNYSKGGVSDQGRFGSIQEPDLQPSCFSRTLRLQKKLLSSGAAHTICLRIQPHNKMEFLPKKEFDTYFCAYEPYEQCPRSVSRATYSSRDDDLWSKNSRFGSNLLCWKAPKQPM

SEQ ID NO: 8018 - protein, 74 aa, Sorghum bicolor
MFPRISRLGARLLRESRAETRAGNLLSSRGILYQGHVNRHSTPVMTPTVLSLRNVLLSTATSGEQDESSQPKDK

SEQ ID NO: 8019 - protein, 130 aa, Zea mays
MIVEVIFLHTVNRISVTFVNKDGSEKTICVPVGMSMLEAAHENDIELEGACEGSLACSTCHVIVMDVKYYNKLEDPADEENDMLDLAFGLTETSRLGCQVIAKPELDGMRLALPVATRNFAVDGYVPKPH

SEQ ID NO: 8020 - protein, 193 aa, Cannabis sativa
MFISKLSRVGVWMVKELCRGKSRTLTSAGYTHRPSSHYLQTLSEAKVSRGAIFQKHRLFSSVNSAPSEEGSEPEEEISVTFVDKDGDEKLIKVPVGMSMLEAAHENDIELEGACEASLACSTCHVIVMDMEYYNKLEDPTDEENDMLDLAFGLTETSRLGCQVIAKPELDGVRLAIPSATRNFAVDGYVPKPH

SEQ ID NO: 8021 - protein, 182 aa, Eschscholzia californica
MFKHKLSQVASLMVKEFTGGGQLSNLSRRSYLRGPCDRSPTPKFRSFASSAADSAHGEVNGQQEKISVTFVDKDGEEKEIKVPIGMSMLEAAHENDIELEGACEGSLACSTCHVIVMDVNYYNKLEDPTDEENDMLDLAFGLTETSRLGCQVIAKPELDGVRLALPAATRNFAVDGYVPKPH

SEQ ID NO: 8022 - protein, 198 aa, Malus domestica
MFASQVSRIGVLILKQLSRGKSVSITRAGDTSNSYRHYLQPLFDQQSETNLLRGTIFEKHRLFSTSSASHSSNEGIEQKEKISVTFVDKDGEEKHIKVPTGMSMLEAAHENDIELEGACEGSLACSTCHVIVMDVDYYSKLEDPTDEENDMLDLAFGLTETSRLGCQVIAKPELDGIRLAIPAATRNFAVDGYVPKPH

SEQ ID NO: 8023 - protein, 118 aa, Amborella trichopoda
RITVTFVDKDGEEKQIKVPVGMSMLEAAHENDIELEGACEGSLACSTCHVIVMDVDYYNKLEDPADEENDMLDLAFGLTETSRLGCQVIAKPELDGIRLALPVATRNFAVDGFVPKPH

SEQ ID NO: 8024 - protein, 170 aa, Abies balsamea
RKINVDADGLSKAGLHLDARIWHNQEQADEQKRNFASKSDKANECEQEANTKTISVTFVDKDGEEKTIKVPVGMSMLEAAHENDIELEGACEGSLACSTCHVIVMDEDYYNKLPEPTDEENDMLDLAFGLTETSRLGCQVIAKPELDGLKVALPPATRNFAVDGYVPKPH

SEQ ID NO: 8025 - protein, 193 aa, Cannabis sativa
MFISKLSRVGVWMVKELCRGKSRTLTSAGYTHRPFSHYLQTLSEAKVSRGAIFQKHRLFSSVNSGPSEEGSEPEEEISVTFVDKDGDEKLIKVPVGMSMLEAAHENDIELEGACEASLACSTCHVIVMDMEYYNKLEDPTDEENDMLDLAFGLTETSRLGCQVIAKPELDGVRLAIPSATRNFAVDGYVPKPH

SEQ ID NO: 8026 - protein, 193 aa, Humulus lupulus
MFISKLSRVGVWMVKELYRGKSRGLTRAGYTHRPFSHNLQALSEAKVSTGAIFQKHRFFSSVSSDPSEEGSELEEEISVTFVDKDGEEKLIKVPVGMSMLEAAHENDIELEGACEASLACSTCHVIVMDMEYYNKLEDPTDEENDMLDLAFGLTETSRLGCQVIAKPELDGVRLAIPSATRNFAVDGYVPKPH

SEQ ID NO: 8027 - protein, 198 aa, Populus trichocarpa
MLRSRLSRIGAGIVKELSRGQCTAMCRSSFILRPYSACWRPQVELHPETKGFQGTIFRKHYQFSSTATSSDSANGSDPEEMISITFVGKDGEEKDIKVPVGMSMLEAAHENDIELEGACEGSLACSTCHVIVMDMEYYNKLEDPADEENDMLDLAFGLTETSRLGCQVIAKPELNGMRLAIPAATRNFAVDGYVPKPH

SEQ ID NO: 8028 - protein, 199 aa, Glycine max
MLNSRVVARVGASIVKHLCTRNCTSLRGVGYIRSARYHHNQPLFQQHSFTKLYKGAMIEKHNFLSTMTTNNTTEEGSEQEQTISVTFIDKDGEEKHIKVPVGMSMLEAAHENDIELEGACEGSLACSTCHVIVMDVEQYNKLEDPTDEENDMLDLAFGLTETSRLGCQVIAKPELDGIRLAIPAATRNFAVDGYVPKPH

SEQ ID NO: 8029 - protein, 180 aa, Amorphophallus konjac
MFLSKLRQAGFRMVSQSKSGQLPVARMGYFQQPFSHYLWPLNRHCSTSATSEVNKEGSEKKEKITVTFVDKDGDEKVIQVPIGMSMLEAAHENDIELEGACEGSLACSTCHVIVMDVDQYNRLEDPTDEENDMLDLAFGLTETSRLGCQVIAKPELDGIRLALPAATRNFAVDGYVPKPH

SEQ ID NO: 8030 - protein, 181 aa, Elaeis guineensis
MVLSRFSQLGARFLKESGIGQFWVTRRGCVKWPSSHYLYPTKSLSFSTAVTGKAQEESSEQKEKITVTFVDKDGEEKVIQVPMGMSMLEAAHENDIELEGACEGSLACSTCHVIVMDMEYYNKLEDPADEENDMLDLAFGLTETSRLGCQVIAKPELDGMRLALPAATRNFAVDGFVPKPH

SEQ ID NO: 8031 - protein, 198 aa, Glycine max
MQNSKVARVGASIVKHLCTRNCTSLCGVGYIRSARYHYKQPLFQHHSFTKLYKGAMIEKHNFLSTMTTNNTTKERSEQEQAISVTFIDKDGEEKHIKVPVGMSMLEAAHENDIELEGACEGSIACSTCHVIVMDVEQYNKLEDPTDEENDMLDLAFGLTETSRLGCQVIAKPELDGIRLAIPAATRNFAVDGYVPKPH

SEQ ID NO: 8032 - protein, 198 aa, Cajanus cajan
MLNSRLARVGASIAKHLYTRNCSSMCRVGYIRSARYNYLQPPFQQHSFTKLYKGAMIEKHHFLSTMTTNNTTEDRSEQKETISVTFIDKDGEEQHIRVPVGMSMLEAAHENDIELEGACEGSLACSTCHVIIMDVEHYNKLEDPTDEENDMLDLAFGLTETSRLGCQVIAKPELDGIRLAIPAATRNFAVDGYVPKPH

SEQ ID NO: 8033 - protein, 254 aa, Pinus pinaster
MQAAAKRAAQLRPLSAGNGFVGLRYALPVQGASSEYKFDHSRCASSLTDNGHLIRTGIGGRSSVSGIIATLFGATGFLDRYIVHQVAKMGSQVLVPFRGLEDSPRHLKLMGYLGQKRNFTSESDKADENQQAANTETISVTFVDKDGEENTIKVPVGMSMLEAAHENDIELEGACEGSLACSTCHVIVMDEDYYNKLPEPTDEENDMLDLAFGLTETSRLGCQVIAKPELDGMKVALPSATRNFAVDGYVPKPH

SEQ ID NO: 8034 - protein, 232 aa, Pinus taeda
MQAAARRAAQLRPLSAGNGFLGLWYALPVQGVSSGIGGRSSVSGIIATLFGATGFLDRYIVHQVAKMGSQVLVPFRGLEDSPRHLKLMGYLGQKRDFTSESDKADEKQQAANTETISVTFVDKDGEENTIKVPVGMSMLEAAHQNDIELEGACEGSLACSTCHVIVMDEDYYNKLPEPTDEENDMLDLAFGLTETSRLGCQVIAKPELDGMKVALPSATRNFAVDGYVPKPH

SEQ ID NO: 8035 - protein, 198 aa, Populus trichocarpa
MSRSRLSRIGVGIVKELSREQCTALCRKSFIRRPYSACWRSQVELHPESKGHQGSIFQKHHQFSSTATSRDSADGSDPNEMISVTFVDKDGEEKDIKVPVGMSMLEAAQENDIELEGACEGSLACSTCHVIVTDMEYYNKLEDPTDEENDMLDLAFGLTETSRLGCQVIAKPELNGMRLALPAATRNFAVDGYVPKPH

SEQ ID NO: 8036 - protein, 62 aa, Sequoia sempervirens
KRGISVTFVDKDGEEKTIQVPVGMSMLEAAHQNDIELEGPVKDRLHVLPAMLLSWMRTIIIN

SEQ ID NO: 8037 - protein, 267 aa, Picea glauca
MALLCRRKTLLYRELHGLGLRESYYSNGKFNRVISSFDQFRVSRMGISKAVQMQPAVKKPSHEEMTKERLPEPRPFDLYRSICSSDRRGGAVAALEGWLNGGRKAAKWEPNRVISDPMKYKRDIHALQKRNFASESDKADENQQEANTETISVTFVDKDGEEKTIKVPVGMSMLEAAHENDIELEGACEGSLACSTCHVILMDEDYYNKLPEPTDEENDMLDLAFGLTETSRLGCQVIAKPELDGMKVALPAATRNFAVDGYVPKPH

SEQ ID NO: 8038 - protein, 282 aa, Picea glauca
  misc_feature (22)..(22): Xaa can be any naturally occurring amino acid
PFFNLSSSVRFGEKSMALLCRXKTLLYRELHGLGLRESYYSNGKFNRVISSFDQFRVSRMGISKAVQMQPAVKKPSHEEMTKERLPEPRPFDLYRSICSSDRRGGAVAALEGWLNGGRKAAKWEPNRVISDPMKYKRDIHALQKRNFASESDKADENQQEANTETISVTFVDKDGEEKTIKVPVGMSMLEAAHENDIELEGACEGSLACSTCHVILMDEDYYNKLPEPTDEENDMLDLAFGLTETSRLGCQVIAKPELDGMKVALPAATRNFAVDGYVPKPH

SEQ ID NO: 8039 - protein, 244 aa, Taxus baccata
LRFSTVSSGNALIPGALLRPFSTTSIRADAERSKKSGSAVKRACQAEERHIRNKSGKILMKTCMKKTLILEGYTNLSHPISSRTTSAYAKMEETNEQRYEGHVESKRRFSSKTGKANDNRAEGNKETISVTFVNKDGEEKTIQVPVGMSMLEAAHQNDIELEGACEGSLACSTCHVIVMDENIYSKLEEPTDEENDMLDLAFGLTETSRLGCQVIAMPELDGMRLALPSATRNFAVDGYVPKTH

SEQ ID NO: 8040 - protein, 117 aa, Platanus occidentalis
ILVTFVDKDGEEKHIKVPIGMSMLEAAHENDIELEGACEASLACSTCHVIVMDVDYYNKLEDPTDEENDMLDLAFGLTETSRLGCQVIAKPELDGIRLALPTATRNFAVDGYVPKPH

SEQ ID NO: 8041 - protein, 123 aa, Nicotiana tabacum
TRKSKQISVTFVDKDGEEKHIKVPVGMSMLEAAHENDIELEGACEGSLACSTCHVIVMDVDYYNKLEDPTDEENDMLDLAFGLAETSRLGCQVIAKPELDGLRLALPAATRNFAVDGYKPKPH

SEQ ID NO: 8042 - protein, 198 aa, Brassica napus
MLFHRLSRLGSRIVKQLPRERHFSVCGMRVLQRSYGHYLQSSAAVLQRQSGTCQQAFFSNNHYLCTSFSTASGNSGEETEKINVIFVDKDGEEIHIKVPVGMNILEAAHENDIELEGACECSLACSTCHVIVMDTEYYNKLEEPTDEENDMLDLAFGLTETSRLGCQVIAKPELDGIRLAIPSATRNFAVDGFVPKPH

SEQ ID NO: 8043 - protein, 154 aa, Eucalyptus grandis
MQPSDKLFQGALLQKHFFCSTTTADGAHGGCDEEKDKISVTFIDKDGEEKQIKVPIGMSMLEAAHENDIELEGACEGSLACSTCHVIVMDVEYYNKLDDPTDEENDMLDLAFGLTETSRLGCQVIARPELDGVRLAIPAATRNFAVDGYVPKPH

SEQ ID NO: 8044 - protein, 144 aa, Setaria italica
MIRAGRNLFCSSTNATTGDSNNKLEARISVTFVDKDGEEKLVKVPIGMSMLEAAHENDIELEGACEGSLACSTCHVIVTDVNYYNKMEDPVDEENDMLDLAFGLTETSRLGCQVIASPELDGIRLALPAATRNFAVDEYVAKSH

SEQ ID NO: 8045 - protein, 247 aa, Gossypium raimondii
SLKRRRSLSLLSPGSLYGAYYSKETCSSNLSQLPSPAGHHLPSKLVRVFVLKRIRDHCPRPPSYLVTKGGYAYMSRSRYTQRHCCQYQWSTLELLPETRAFQGSIFQKHHGFSTSASDGASAGADEEKGTIPVTFVSKDGEEIPIQVPIGMSMLEAAHENDIELEGACEGSLACSTCHVIVMDMEYYNKLEDPADEENDMLDLAFGLTETSRLGCQIVASPELDGIRLAIPAATRNFAVDGYVPKPH

SEQ ID NO: 8046 - protein, 164 aa, Carpinus betulus
MCTKALLPIFCFHCFERNTETKPFQEAIFQKPHHFSTTTADNASEETISVTFVDKDGEEKHIKVPIGMSMLEAAHENDIELEGACEGSLACSTCHLIVMDMEQYNKLEDPTDEENDMLDLAFGLSETSRLGCQVIAKPELDGIRLAIPAATRNFAVDGYVPKPH

SEQ ID NO: 8047 - protein, 190 aa, Pinus pinaster
LYARCSSDHRGRAIASSERCWLNEGRKALKWEPNRIISDQMKYKRNTHSLQKRNFASESDKANEHQQEANTETISVTFVDKDGEEKTVKVPVGMSMLEAAHENDIDLEGACEGSLACSTCHIIVMDEDYYNNLPEPTDEENDMLDLAFGLTETSRLGCQVIAKPELDGMKVALPAATRNFAVDGYVPKPH

SEQ ID NO: 8048 - protein, 267 aa, Picea glauca
MALLCRRKTLLYRELHGLGLRESYYSNGKFNRVISSFDQFRVSRMGISKAVQMQPAVKKPSHEEMTKERLPEPRPFDFIRSICSSDRRGGAVAALEGWLNGGRKAAKWEPNRVISDPMKYKRDIHALQKRNFASESDKADENQQEANTETISVTFVDKDGEEKTIKVPVGMSMLEAAHENDIELEGACEGSLACSTCHVILMDEDCYNKLPEPTDEENDMLDLAFGLTETSRLGCQVIAKPELDGMKVALPAATRNFAVDGYVPKPH

SEQ ID NO: 8049 - protein, 180 aa, Setaria italica
MLSRLSRAGLQALNRARPGQNSVPSRSHEVEAISTYMIRAGRNLFCSSTNATTGDSNNKLEARISVTFVDKDGEEKLVKVPIGMSMLEAAHENDIELEGACEGSLACSTCHVIVTDVNYYNKMEDPVDEENDMLDLAFGLTETSRLGCQVIASPELDGIRLALPAATRNFAVDEYVAKSH

SEQ ID NO: 8050 - protein, 179 aa, Guizotia abyssinica
MFISRFSRLGFKGLSKGPLTIGPKRSFSRISPIVQNDYLELSRFKLFSTTATENLQENEETPKISVTFFDKDGEQEIKVPVGMSMLEAAHENDIELEGACEGSLACSTCHVIVMDVEQYNKLEDPTDEENDMLDLAFGLTETSRLGCQVIAKPELDGLRLALPAATRNFAVDGFKPKPH

SEQ ID NO: 8051 - protein, 152 aa, Lotus japonicus
FQMHSFTKSYKGAMCEQNNFLSTMTTNSTNSTLCRISVTIIDKDCEEKIIKVPVGMSMLEATNENDIELEGACEGSLACSTCHLIVMDVEYYNKLEDPADEENDMLDLAFGLTETSRLGCQVIAKPELDGIRLAIPSATRNFAVDGYVSKPH

SEQ ID NO: 8052 - protein, 97 aa, Cajanus cajan
MSMLEAAHENDIELEGACEGSLACSTCHVIIMDVEHYNKLEDPTDEENDMLDLAFGLTETSRLGCQVIAKPELDGIRLAIPAATRNFAVDGYVPKPH

SEQ ID NO: 8053 - protein, 147 aa, Sciadopitys verticillata
KLTGYLGQKQSFTSESDKVYNNHGEGNKEIISVTFVDRDGEEKNIQVPVGMSMLEATHQNDIDLEGACEGSLACSTCHVIVMDENYYSKLEEPTDEENDMLDLAFGLTEMSRLGCQVIAKPELDGIRLALPSATRNFAVDGYVPKPH

SEQ ID NO: 8054 - protein, 129 aa, Cephalotaxus harringtonia
MINVQKGTRKRGISVTVVDKDGEEKTIQVPVGMSMLEAAHQNDIELEGACEGSLACSTCHVIVMDENYYNKLEEPTDEENDMLDLAFGLTEMSRLGCQVIARPELNGIRLALPSATRNFAVDGYVPKPH

SEQ ID NO: 8055 - protein, 116 aa, Castanea mollissima
SVTFVDKDGEEQHIKVPIGMSMLEAAHENDIELEGACEGSLACSTCHVIVMDMEYYNKLEDPADEENDMLDLAFGLTETSRLGCQVIAKPELDGIRLAIPAATRNFAVDGYVPKPH

SEQ ID NO: 8056 - protein, 195 aa, Fragaria vesca
MLGFRASRIGLLILKQLTRDKSICTPTYATRSFTQFLQPLYNQQSGTRLFRGAIFQKHHHFSTTTASTSDQGTEQKETISVTFVDKDGDERHIKVPIGMSMLEAAHENDIELEGACEGSLACSTCHVIVMDMEYYNKLEDPTDEENDMLDLAFGLTETSRLGCQVIASPELDGVRLAIPAATRNFAVDGYVPKPH

SEQ ID NO: 8057 - protein, 204 aa, Trigonella foenum-graecum
MLNLNSRLARAAISISKHLSTRKNYTSMSMSRAGYTPTASNYYRLQYSFQQNGLTNLYKGAMFKKHNFLSTTTSNNTAEGESEEDKTISVTFVDKDGEEKLIKVPIGMSMLEAAHENDIELEGACEGSLACSTCHVIVMDVEYYNKLEDPTDEENDMLDLAFGLCETSRLGCQVIATPELDGVRLALPAATRNFAVDGYMPKPH

SEQ ID NO: 8058 - protein, 244 aa, Phaseolus coccineus
MRRQWRSFAAAMENVGGSGDDGWRRRWLKLAPAVAWAVAENMNLKMAALGQINLEQKRVALDYDGNRGRLPMQLCTELRSATFQRHSFTKLYKGAMIYKGAMMERHNFLSTMTTNNTIEEGSEQKETISVTFIDKDGEENHIKVPVGMSMLEAAHENDIELEGACEGSLACSTCHVIVMDVEHYNKLEDPTDEENDMLDLAFGLSETSRLGCQVIAKPELDGIRLAIPAATRNFAVDGFVPKPH

SEQ ID NO: 8059 - protein, 199 aa, Ricinus communis
MLVSSRLSRIGSGIVKQLSRGICTSLSRTEFVRTPYSQYWRPQGELHPETKGFRGTLSPRYHLFSTTASGNDIADGDEQKHKISVTFVDKDGEEKHIKVPLGMSMLEAAHENDIELEGACEGSLACSTCHVIVMDMEHYNKLEDPTDEENDMLDLAFGLTETSRLGCQVIAKPELDGIRLAIPAATRNFAVDGYVPKPH

SEQ ID NO: 8060 - protein, 196 aa, Arachis hypogaea
MLSSRLPRLGPWIAKRLFTRNYASIYRGRYNQSTRNRFLQPPAVQFQQLSLNKLYNGAMIGKHNFLSTTSNEGNEQKETISVTFVDKDGEEQHIRVPVGMSMLEAAHENDIELEGACEGSLACSTCHVIVMDVEYYNKLEDPTDEENDMLDLAFGLSETSRLGCQVIAKPELDGIRLAIPAATRNFAVDGYVPKPH

SEQ ID NO: 8061 - protein, 129 aa, Tripterygium wilfordii
NADSADKGEQQEISVTFVDKDGEEKHIKVPVGMSMLEAAHQNDIELEGACEGSLACSTCHVIVMDMEYYNKLEEPTDEENDMLDLAFGLTETSRLGCQVIAKPELDGVRLAIPAATRNFAVDGYVPKPH

SEQ ID NO: 8062 - protein, 196 aa, Citrullus lanatus
MSLFKLSRNGVRMIKELFIGQSLLVTKASYIQGPFFKYLHTLPQAPVQVLQGFKWQEQRLYSTSGPQNGSNEDNEPKETISVTFVLKDGEEQQIRVPIGMSMLEAAHLNDIELEGACEGSLACSTCHVIVMDMDYYNKLEEPVDEENDMLDLAFGLTETSRLGCQVIAKPELDGIRLAIPAATRNFAVDGFTPKPH

SEQ ID NO: 8063 - protein, 117 aa, Tripterygium wilfordii
ISVTFVDKDGEENHIKVPVGMSMLEAAHENDIELEGACEASLACSTCHVIVMDMDYYNKLEDPTDEENDMLDLAFGLTETSRLGCQVIAKPELDGVRLAIPSATRNFAVDGYVPKPH

SEQ ID NO: 8064 - protein, 97 aa, Cannabis sativa
MSMLEAAHQNDIELEGACEGSLACSTCHVIVMDMEYYNKLEEPTDEENDMLDLAFALTETSRLGCQVIAKPELDGVRLAIPAATRNFAVDGYVPKPH

SEQ ID NO: 8065 - protein, 194 aa, Humulus lupulus
MFIPKFLRVGIWTVKELSRGKSSTVIRARYTQSPFSQYLQTLSENKVSKGAIFQKLRHFSSATDNDPSQEGSGQEEKISVTFVDKDGEEKHIKVPIGMSMLEAAHQNDIELEGACEGSLACSTCHVIVMDMEYYNKLEEPTDEENDMLDLAFALTETSRLGCQVIAKPELDGVRLAIPAATRNFAVDGYVPKPH

SEQ ID NO: 8066 - protein, 192 aa, Brassica napus
MLFHRLSRLGSRIVKELPRERHFSVSGMRVLQGSYSQYLQSSAVTQRQSRTFQQAFFSSNYNLCTLFSTISETEKINVIFVDKDGEEIHIKVPVGMNILEAAHENDIELEGACECSLACSTCHVIVMDTEYYNKLEEPTDEENDMLDLAFGLTETSRLGCQVIAKPELDGIRLAIPSATRNFAVDGFVPKPH

SEQ ID NO: 8067 - protein, 192 aa, Brassica napus
MLFHRLSRLGSRIVKELPRERHFSVSGMRVLQRSYSQYLQSSAVTQRQSRTFQQAFFSSNYNLCTSFSTISETEKINVIFVDKDGEEIHIKVPVGMNILEAAHENDIELEGACECSLACSTCHVIVMDTEYYNKLEEPTDEENDMLDLAFGLTETSRLGCQVIAKPELDGIRLAIPSATRNFAVDGFVPKPH

SEQ ID NO: 8068 - protein, 177 aa, Cichorium intybus
MFISKFSRLGAQAFKGLSKAPLTIPSRKSFFPIVQNDYLDASSRKLFSTTNSQEENEDKKKISVTFFDKDGEQEIKVPIGMSMLEAAHENDIELEGACEGSLACSTCHVIVMDVEQYNKLEDPTDEENDMLDLAFGLTETSRLGCQVIAKPELDGLRLALPAATRNFAVDGYKPKPH

SEQ ID NO: 8069 - protein, 269 aa, Pinus taeda
MGLLCRLTTLFYRELHGLGLSEACHSNGKFNPANYSFDQFRVWRMGTSKAFQMQPFAPERRSYEETMKERLPQPLSFDLYRSRCSSDHRGRAVASSERCWLNEGRKASKWEPNRIISDQMKYKRNIHSLQRRNFASESDKANENQQEANTETILVTFVDKDGEEKTVKVPVGMSMLEAAHENDIDLEGACEGSLACSTCHIIVMDEDYYNKLPEPTDEENDMLDLAFGLTETSRLGCQVIAKPELDGMKVALPAATRNFAVDGYVPKPH

SEQ ID NO: 8070 - protein, 150 aa, Pseudotsuga menziesii
MNYMRDIHVLQKRNFASESDKVNENQEEANTETISVTFVDKYGEEKIIKVPVGMSMLEAAHENDIDLEGACEGSLACSTCHVIVMDVGYYNKLPEPTDEENDMLDLAFGLTEMSRLGCQVIAEPELDGMRVALPAATRNFAVDGYVPKPH

SEQ ID NO: 8071 - protein, 180 aa, Brachypodium distachyon
MFSRIFQLGTRLLRETRAGGNLTSNSINSSYYQGQLSRHSAPAKSILFSTATSSHEGSEDKEKISVTFVNKDGSEQTISVPVGMSMLEAAHENDIELEGACEGSLACSTCHVIVMDVKHYNKLEDPTDEENDMLDLAFGLTETSRLGCQVIAKPELDGVRLALPAATRNFAVDGFVPKPH

SEQ ID NO: 8072 - protein, 200 aa, Carica papaya
MLISRLSKIGFRIVKELPRVGTCTSLNRGALIQRKCGQYLQPQNGLWGAEKVFQIAACQRHRYFSTTPSNNGLTQEGNQEKEMISVTFVDKEGEEKNIKVPVGTSMLEAAHENDIELEGACEGSLACSTCHVIVMDVEYYNKLDDPTDEENDMLDLAFGLTETSRLGCQIVARPELDGIRLAIPAATRNFAVDGYVPKPH

SEQ ID NO: 8073 - protein, 196 aa, Phaseolus coccineus
MLNSKLARVGASIAKHLFTRNCTSLCGVRYVRTGRCHPLQSQRHSFTKLYKGAMMERHKFLSTMTTNNTIEEGSEQKETISVTFIDKDGEENHIKVPVGMSMLEAAHENDIELEGACEASLACSTCHVIVMDVEHYNKLEDPTDEENDMLDLAFGLSETSRLGCQVIAKPELDGIRLAIPAATRNFAVDGFVPKPH

SEQ ID NO: 8074 - protein, 195 aa, Fagus grandifolia
MLVSKVSRAGLWMLRQLSRGKSTPITRAGYIQRPYGLYLQPLFDQQTKTKVFGGAIQHHFSTTTTDNASEEGSETKEAISVTFVDKDGEEQHIKVPIGMSMLEVAHENDIELEGACEGSLACSTCHVIVMDMEYYNKLEDPADEENDMLDLAFGLTETSRLGCQVIASPELDGIRLAIPAATRNFAVDGYVPKPH

SEQ ID NO: 8075 - protein, 144 aa, Lactuca sativa
MTIRVINYSPQQPLAIHKEKTKTTTKKISVTFFDKDGEEQEIKVPIGMSMLEAAHENDIELEGACEGSLACSTCHVIVMDVEQYNKLEDPTDEENDMLDLAFGLTETSRLGCQVIAKPELDGLRLALPAATRNFAVDGYKPKPH

SEQ ID NO: 8076 - protein, 196 aa, Cucumis melo
MSLFKLSRNGVRMLKELFTGNSLLVTKASHVRGPFFKYLRTLPQPQVQVLQGFKWQEQRLYSTSGPQNGCNEENEPKETISVTFVLKDGEEQQIEVPVGMSMLEAAHQNDIELEGACEGSLACSTCHVIVMDMDYYNKIEEPVDEENDMLDLAFGLTETSRLGCQVIAKPELDGIRLAIPAATRNFAVDGFTPKPH

SEQ ID NO: 8077 - protein, 195 aa, Cucurbita pepo
MSLFKLSRNGVRMMKELFVGQSLLVAKASCIRGPFFKYWRPLPQAQVQVLQGLKWQGQRLYSTSGPQNSCIEESEPETISVTFVLKDGEEQQISVPIGMTMLEAAHLNDIELEGACEGSLACSTCHLIVMDMGYYNKLEEPVDEENDMLDLAFGLTETSRLGCQVIAKPELDGIRLAIPSATRNFAVDGYTPKPH

SEQ ID NO: 8078 - protein, 181 aa, Oryza sativa
MLARVSRLGLHALRRATAPGQNSLASRRHEAEAVTSHVNHLGKTFFCSNTNATSSDRSSESEAKISVTFVDKDGEEKLVKVPIGMSMLEAAHENDIELEGACEGSLACSTCHVIVTDVDYYNKLEDPVDEENDMLDLAFGLTETSRLGCQVIASPELDGMRLALPSATRNFAVDGYVAKSH

SEQ ID NO: 8079 - protein, 196 aa, Euonymus alatus
MLISRLSRVGFPIIRSLSRGLSRHVYRTGYNQSSYCGRRHWYELQPQTRWFHGAIFERNRCCFTTAADANAADKGEQQEISVTFVDKDGEEEHIKVPVGMSMLEAAHQNDIELEGACEASLACSTCHVIVMDMEYYNKLEDPTDEENDMLDLAFGLTETSRLGCQVIAKPELDGVRLAIPSATRNFAVDGHVPKPH

SEQ ID NO: 8080 - protein, 97 aa, Olea europaea
MSMLEAAHENDVELEGACEGSLACSTCHVIVMDVDYYNKLEDPADEENDMLDLAFGLTDTSRLGCQIIAKPEIDGIRLALPVATRNFAVDGYKPKPH

SEQ ID NO: 8081 - protein, 106 aa, Vinca minor
GKENKDTQKISVTFVDKDGEENQIKVPVGMSMLEAAHENDIDLEGACEGSLACSTCHVIVMDVEQYNKLEDPTDEENDMLDLAFGLTETSRLGCQIIASPEMMEFD

SEQ ID NO: 8082 - protein, 197 aa, Arabidopsis thaliana
MVFHRLSRLGSRIVKELPRERHLSMCGKRILQRSYGQYLQSSPMLQRQTRSFKEALFSNNHKFCTSFSTTSEKGGEKTEKINVTFVDKDGEEIHIKVPVGMNILEAAHENDIELEGACEGSLACSTCHVIVMDTKYYNKLEEPTDEENDMLDLAFGLTATSRLGCQVIAKPELDGVRLAIPSATRNFAVDGFVPKPH

SEQ ID NO: 8083 - protein, 134 aa, Cucumis sativus
MALMKRMNQKKQTVICRISVTFVLKDGEEQQIRVPVGMSMLEAAHQNDIELEGACEGSLACSTCHVIVMDMDYYNKIEEPVDEENDMLDLAFGLTETSRLGCQVIAKPELDGIRLAIPAATRNFAVDGFTPKPH

SEQ ID NO: 8084 - protein, 180 aa, Pennisetum glaucum
MLSRFSRAGLQALNRARPGQKSVPSWNHEVEAISTYMIRAGRNLFCSSTNSTTGDSNNKPEARISVTFVDKDGEEKLVKVPIGMSMLEAAHENDIELEGACEGSLACSTCHVIVTDVNYYNKMEDPVDEENDMLDLAFGLTETSRLGCQIIASPELDGIRLALPTATRNFAVDGYVAKSH

SEQ ID NO: 8085 - protein, 244 aa, Physcomitrella patens
MRGLRVATGLAARLLQHGRVAELRTGSVGIFRSLVCNNPSATYDSSLNSRVSDTCGFSSRVSIQGSSCAPRHEPGFVSNVSLGASGEIVEPNKFILSYLGSSQLFPPGRSNGFSTSAAATPEADAEKISVTFVNKDGEETEIKVPVGMSMLEAAHENDIELEGACEGSLACSTCHVIITDEELYNKLPEPTDEENDMLDLAFGLTETSRLGCQVIAKPELDGLRLALPAATRNFAVDGHVPKPH

SEQ ID NO: 8086 - protein, 120 aa, Rosa hybrid cultivar
HETISVTFVDKDGDEKHIKVPIGMSMLEAAHQNDIELEGACEGSLACSTCHVILMDVEYYNKLEDPTDEENDMLDLAFGLTETSRLGCQVIASPELDGVHLAIPAATRNFAVDGYVPKPH

SEQ ID NO: 8087 - protein, 71 aa, Zea mays
MLRNGNEGMSTIPGFSQIQFEGFCRFINQGLAEELEKFPTIKDPDHEIAFQLFAKGYQLLEPSIKRKECCV

SEQ ID NO: 8088 - protein, 135 aa, Saccharum officinarum
  misc_feature (119)..(119): Xaa can be any naturally occurring amino acid
  misc_feature (123)..(123): Xaa can be any naturally occurring amino acid
MLRNGNEGMSTIPGFSQIQFEGFCRFINQGLAEELEKFPTIKDPDHEIAFQLFAKGYQLLEPSIKERNAVYESLTYSSELYVSARLIFGFDVQKQTISIGNIPIMNSLGTFIINGIYRXVINXILLSPGIYYRLE

SEQ ID NO: 8089 - protein, 397 aa, Saccharum officinarum
MEGMEEANRTAVQSCHRVLALLSNPHGQLVPSKDLVAATGDAVAKFGSLTAKLSNSNGNGLQLQGHARVRKIKKPLPIFDSNLFLESSAVAAAATVAKTPSPSPITGLQLFPRYHQMEGSSSKDPIRIPAQFPKRLLLENPAAGLEGPSSKAPPVQMVQPVSVAPPAGTPTPALPAAHLHFLQQHQSYQRFQLMHQMKFQNEMMKRNNLGDQGGSLSGGSGGGGKGVNLKFDSSNCTASSSRSFLSSLSMEGSLVSLDRNRASRPFQLVSGSQTSSTPELGLVHRRRCAGREDGSGRCTTGSRCHCSKKRKLRIRRSIKVPAISNKVADIPSDEFSWRKYGQKPIKGSPHPRGYYKCSSVRGCPARKHVERCVDDPSMLIVTYEGDHNHNRVLAQPA

SEQ ID NO: 8090 - protein, 397 aa, Zea mays
MEGMEEANRTAVESCHRVLALLSNPHGQLVPSKELVAATGEAVAKFGSLTAKLSNSNGDGLLQGHARVRKVKKPLHIFDSNLFLESSAVAAAAAPAKTPSPSPILGLQLFPRYHQFEGSSSKDPVRIPTQFPKRLLLEKPTAGMEGSTSQSPPIVQMVQPVSVAPPAGTPTPALPPAHLHFIQQQQSYQRFQLMQQMKIQSEMMKRSNLGDQGGSLSGGGGGGRKGVNLKFDSSNCTASSSRSFLSSLSMEGSLASLDGSRTSRPFQLLSGSQTASTPELGLVQRRRCAGREDGTGRCATGSRCHCSKKRKLRIRRSIKVPAISNKVADIPADEFSWRKYGQKPIKGSPHPRGYYKCSSVRGCPARKHVERCVDDPSMLIVTYEGDHNHNRVLAQPA

SEQ ID NO: 8091 - protein, 394 aa, Setaria italica
MEGMEEANRAAVESCHRVLALLSNPRGQLVPNKDLVAATGEAVGKFGSLTAKLSNSNGNGLQGHARVRKIKKPLPIFDSNLFLESSAVAVAAATPAKAPSASPITGLQLFPRYQMEGSSSKDPIRIHTQFPKRLMLENPAAALEGPSSQAPPVHMVQPVSVAPPAGTPTPALPAAHLHFIQQQQSYQRFQLMQQMKIQNEMMKRSIGDQGGSLSGGGGGGAKGVNLKFDTSNCTASSSRSFLSSLSMEGSLASLDGSRANRPFQLVSGSQASSTPELGLVQRKRCTGREDGSGRCATGSRCHCSKKRKLRIRRSIKVPAISNKVADIPADEFSWRKYGQKPIKGSPHPRGYYKCSSVRGCPARKHVERCVDDPSMLIVTYEGDHNHNRVVAQPA

SEQ ID NO: 8092 - protein, 395 aa, Zea mays
MEAMEEANRTAVESCHRVLALLSNPHGQLVPSRELVATTGEAVARFGSLAAKLSSSNGNGLQGHARVRKTKKPLPIFYSNLFLESSSAVAAAATVAKTPSPSPTTGLQLFPRYHQMEGSSCKDPVRIPAQFPKRLLLENLAAGLEGSSPPAPPVRMVQPVSVAPPAGMPTPALPAAHLHFIQQQQSYQRFQLMQQMKIQSEMVKRSNLGEQGGSLSGGGGGGKGVNLKFDSSNCTASSSRSFLSSLSMEGSLASLDGSRASRPFQLVSGSQTSSTPELGLVQRRRCAGKEDGSGQCATGSRCHCSKKRKLRIRRSIKVPAVSNKVADIPADEFSWRKYGQKPIKGSPHPRGYYKCSSVRGCPARKHVERCVDDPSMLIVTYEGDHNHSRVLAQPA

SEQ ID NO: 8093 - protein, 387 aa, Oryza sativa
MEGMEEANREAVQSCHRVLTLLSSPHSQLVPNKDLAAATGEAVAKFCSVASRLNNGNGLQGHARVRKIKKPLPIFDSNLFLESPALAVAMAAKTPNSSPITSLQLFPRYHQMEGSSSKDPVRIPAQFPKRLLLDNPAVDSDGPSRGPPLQLIQPVSVAPPAGTPHPALPSAHLHFIQQHQSYQRFQLMQQMKMQSEMIKRSGLGEQGGSNGGGKGVNLKFDSSNCTASSSRSFLSSLSMEGSIASLDGSRSSRPFQLVSGSQTSSTPELGLMQRRRCTGREDGSGRCTTGSRCHCAKKRKLRIRRSIKVPAISNKVADIPADEFSWRKYGQKPIKGSPHPRGYYKCSSVRGCPARKHVERCVDDPSMLIVTYEGDHNHNRVLAAQPA

SEQ ID NO: 8094 - protein, 440 aa, Sorghum bicolor
MATDGGEKGSSGHAAAEWRFARAAAAKEEGALAVAGDKMSIRAARFKISASVDARDPRPVLPLAHGDPSVFPAFRTAAEAEDAVAAALRTGKFNCYPAGVGLPDARRALAEHLSSDLPYKLSTDDIFLTAGGTQAIEVVVSVLAQPGTNILLPRPGYPNYEARAGLHNLEVRRFDLIPERGWEIDIDSLESIADKNTTAMVIINPNNPCGSVYTHEHLAKVAEVARKLGILVIADEVYGNLVFGDTPFVPMGVFGHIAPVLSIGSLSKRWIVPGWRLGWVAVCDPNKILLNTKIIASITNFLNISTDPATFIQGALPHILENTKEDFFKRIIGLLAETSEICYREIKDIKCITCPHKPEGSMFVMVKLNLYLLEGIHDDIDFCCKLAKEESVILCPGSVLGMENWIRITFAIDSSSLLDGLERIKSFCQRHKKKNLLNGH

SEQ ID NO: 8095 - protein, 437 aa, Saccharum officinarum
MATHGGENGSGHAAEWRFARVAKEGEGALAVAGDKLSIRAARFKISASVDARDPRPVLPLAHGDPSVFPAFRTAAEAEDAVAAALRTGKFNCYPAGVGLPDARRALAEHLSSDLPYELSTDDIFLTAGGTQAIEVVVSVLAQPGTNILLPRPGYPNYEARAGLHNLEVRRFDLIPERGWEIDIDSLESIADNNTTAMVIINPNNPCGSVYTREHLAKVAEAARKLGILVIADEVYGNLVFGDTPFVPMGVFGHIAPVLSIGSLSKRWIVPGWRLGWVAVCDPNKILQKTKIIASITNFLNVSTDPATFIQGALPHILENTKEDFFKRIIGLLAETSEICYREIKDIKCITCPHKPEGSMFVMVKLNLYLLEGIHDDIDFCCKLAKEESVILCPGSVLGMKNWIRITFAIDSSSLLDGLERIKSFCQRHKKRNLLNGH

SEQ ID NO: 8096 - protein, 434 aa, Zea mays
MATHASDNGSGHAEWRFARAAKEGALAVAGDKMSIRAARFKISASVDGRDPRPVLPLAHGDPSVFPAFRTAAEAEDAVAAALRTGKFNCYPAGVGLPEARRALAEHLSSDLPYKLSTDDIFLTAGGTQAIEVVVSVLAQPGANILLPRPGYPNYEARAGLHNLQVRHFDLIPERGWEIDIDSLESIADKNTTAMVIINPNNPCGSVYTREHLAKVAEVARKLGILVIADEVYGNLVFGDTPYVPMGVFGHIAPVLSIGSLSKRWIVPGWRLGWVAVCDPNKILQETKIIASITNFLNVSTDPATFVQGALPHILENTKEDFFRRIIGLLAETSEICYREIKDIKCITCPHKPEGSMFVMVKLNLYLLEGIHDDIDFCCKLAKEESVILCPGSVLGMENWIRITFAIDSSSLLDGLERIKSFCQRHKKKNLLNGH

SEQ ID NO: 8097 - protein, 440 aa, Zea mays
MATHAGENGSGHENGGGHAEWRFARAAKEGALAVAGDKMSIRAVRFKISASLDARDPRPVLPLAHGDPSVFPAFRTAAEAEDAVAAALRTGKFNCYPAGVGLPEARRALAEHLSSDLPYKLSSDDIFVTAGGTQAIEVVVSVLAQPGTNILLPRPGYPNYEARAGLHNLEVRRFNLIPERGWEIDIDGLESIADKNTTAMVIINPNNPCGSVYTREHLAKVAEVARKLGILVIADEVYGNLVFGDTPFVPMGVFGHIAPVLTIGSLSKRWIVPGWRLGWVAVCDPNKVLQETKIIASITNFLNVSTDPATFVQGALPHILKNTKEDFFKRIIGLLAETSEICFSGIKDIKCITCPHKPEGSMFVMVKLNLYLLESIHDDIDFCCKLAKEESVILCPGSVLGMENWIRITFAIDSSSLLDGLERLKSFCQRHKKKNLLNGH

SEQ ID NO: 8098 - protein, 444 aa, Pennisetum glaucum
RQSGGARAAEDINGNGHAKAPAADWQFARAVKDSPLAGAGDRMSIRAVRFKISASVDARDPRPVLPLAHGDPSTFPAFRTAAEAEAAVAAALRTGKLNCYPAGVGLPDARRALAKHLSSDLPYELSSDDIFLTAGGTQAIEVVISVLAHPGTNILLPRPGYPNYEARAALNNLEVRHFDLIPERGWEIDIDSLESVADKNTTAMVIINPNNPCGSVYTHEHLAKVAEVARKLGILVIADEVYGNLVFGDSQFIPMGVFGHIAPVLTIGSLSKRWIVPGWRLGWVAACDPKKILQDTKILMSITNFLNVSTDPATFIQGALPQILENTKEDFFKRVIGLLEETSELCYREIKDIKCITCPHKPEGSMFVMVKLNLYLLEGIHDDIDFCCKLAKEESVILCPGSVLGMENWVRITFAIDSSSLLDGLERIKSFCQRHKNKNLLSGF

SEQ ID NO: 8099 - protein, 450 aa, Setaria italica
MATLHQNGGARAAEDVNGNGNGHAAAPAAEWQFARAVKDGALAAAGDRMSIRAVRFKISASVDARDPRPVLPLAHGDPSTFPAFRTAAEAEAAVAAALRTGKLNCYPAGVGLPDARRALAKHLSSDLPYELSSDDIFLTAGGTQAIEVVISVLAQPGTNILLPRPGYPNYEARAALNNLEVRHFDLIPERGWEIDIDSLESIADKNTTAMVIINPNNPCGSVYTREHLAKVAEVARKLGILVIADEVYGNLVFGDSPFIPMGVFGHIAPVLTIGSLSKRWIVPGWRLGWVAACDPKKILQETKILTSITNFLNVSTDPATFIQGALPQILENTKEEFFKRIIGLLEETSEICYREIKDIKCITCPHKPEGSMFVMVKLNLYLLEGIHDDIDFCCKLAKEESVILCPGSVLGMENWVRITFAIDSSSLLDGLERIKSFCQRHKKKNLLSGF

SEQ ID NO: 8100 - protein, 402 aa, Panicum virgatum
MSIRAVRFKISASVDARDPRPVLPLAHGDPSVLPAFRTAAEAEEAVAAALRTGRLNCYPAGVGLPDARRALAKHLSRDLPYDLSSDDIFLTAGGTQAIEVVISVLAQPGTNILLPRPGYPNYEARAALNNLEVRHFDLIPEKGWEIDIDSLESIADKNTAAMVIINPNNPCGSVYTREHLAKVAEAARKLGILVIADEVYGNLVFGDSQFIPMGVFGHIAPVLSIGSLSKRWIVPGWRLGWVAACDPKKILQETKILTSITNFLNVSTDPATFIQGALPQILENTKEDFFKRIIGLLEETSDICYREIKDIKYITCPHKPEGSMFVMVKLNLYLLEGIHDDIDFCCKLAKEESVILCPGSVLGMKNWVRITFAIDSSSLLDGLERIKSFCQRHKKKNLLNGI

SEQ ID NO: 8101 - protein, 494 aa, Oryza sativa
MHASCCCAPPESVSHTRRISYKYSGTSYPTRTTTTSSSAPEFTNKKQSTAMAPTTAAAAASSNGGGESDGSSKEWRLTAPTRGGAMAAAGDKMSIRAVRYKISASVDDRGPRPVLPLAHGDPSVFPEFRTAAEAEDAVADALRSGDFNCYPAGVGLPAARRAVADHLSRDLPYKLSSDDIFLTAGGTQAIEVVISILAQPGTNILLPRPGYPNYEARAAFNNLEVRHFDLIPEKGWEIDLNSLESIADKNTTAIVIINPNNPCGNVYTYEHLSKVAEVARKLGILVITDEVYGNLVFGSSPFVPMGCFGHIVPILTIGSLSKRWIVPGWRLGWVAICDPKKTLQETKIATLITNFLNVSTDPATFIQGALPNILKNTKEEFFKRIIDLLTETSDICYRGIKDIKCITCPHKPEGSMFVMVKLNLYLLEGIHDDVDFCCQLAKEESVILCPGSVLGMKNWVRITFAIDSSSLLDGLERIKSFCQRHKKKNPLNYI

SEQ ID NO: 8102 - protein, 85 aa, Zea mays
MTKDETLLVFTLVVSSVSIFLFGILLFMVLISATRDFRERTKSKLVKIMIWAGIVVITFAIAVRIYPIFIFCSKKRIKLILDRSY

SEQ ID NO: 8103 - protein, 62 aa, Zea mays
MTKDETLLVFTLVVSSVSIFLFGILLFMVLISATRDFRERTKSKLVKIMIWAGIVVITFAIA

SEQ ID NO: 8104 - protein, 89 aa, Zea mays
MTKDETLLVFTLVVSSVSIFLFGILLFMVLISATRDFRERTKSKLVKIMIWAGIVVITFAIAVRIYPIFIFLLKERIKPLVEALYDKLP

SEQ ID NO: 8105 - protein, 65 aa, Secale cereale
MTKDETLLVFTLVVSSSSVSVFLFGILLFMVLISATLDFRERTKSKLVKIMIWAGTVLGSFDRFP

SEQ ID NO: 8106 - protein, 191 aa, Setaria italica
MTKDETLLVFTLVVSSVSVFLFGILLFMVLISATRDFRERTKSKLVKIMIWAGIVVITFAIAVRISDLYLFAQERIKPLVEALYDKLPGSGKIQTGIRKQKGEFVVTFSCRVKKRLYARAIEVGIHLSLLSNLFWILKTTLAGFLGSFRLYLVYFGFYCLLFSGRWLRTSEDRGERQAQISGILLRGMLIQ

SEQ ID NO: 8107 - protein, 525 aa, Setaria italica
MEVEVAAKVAAGLCCVGAITLALYLYHALWLAPERVRAALREQGIAGPRPSFPYGNRAEMRQAAADAKQAAAAASQRGSIVHDYRPALFPHYERWRKEYGPVFTYSIGNMVFLHASRADVVRDLGLCVSLDLGKSSYMKVTHRPLFGDGILKSSGEAWAYQRRLIAPEFFPDKVRGMVDLMVGSATALVESWEDRIISRDNNGGGGGLELKIDDDIRAYSADVISRTCFGSSYVKGKEIFAMIRELQKTVSKPNLLAEMTGLSSLPTRANRAAWRLNRQVSRLVLDVVRESGNDDRNLLSAMLRSAASSGGSVAAEDFIVDNCKNIYFAGYETTAVTAAWCLMLLALHPEWQCRVRDEVRHACAGAGAAPDFTSLQRMKKLTMVIQETLRLYPAGSVLSRQALRGVTLGGVRVPAGVNIYVPVSTVHLDPALWGADAREFHPDRFAGARPPPPPHAYLPFGAGARTCLGQSFAMAELKVLLALVLSKFELSLSPAYVHSPALRLIVEPEHGVRLVLKSVVEPRSS

SEQ ID NO: 8108 - protein, 216 aa, Zea mays
MNSKERRNKEMRRLFLEQFHKQIFPSTPITSFFLFLSYIVVTPLMIGFEKDFSCHSHLGSIRISLLFPFPPEPFPRNDKESGTLELYYLSAYCLPKILLLQLVGHRVIQISRVFCAFPMLQLPYQFDRSGMDRLNILLGSPVLTLLCGIHSRSALGVTSSSGWNSSQNPTTSPTLLPPTVSRTSIETEGFHVLSSIGYSSPFVSLYPISVSISSQD

SEQ ID NO: 8109 - protein, 208 aa, Zea mays
MVREEITGSTQTLEWKCVESRVDSKRLYYGRFILSPLRKGQADTVGIALRRALLGEIEGTCITRAKFGNVPHEYSTIVGIEESIQEILLNLKEIVLRSNLYGVIDASICVKGPRYITAQDIILPPSVEIVDTTQPIANLREPVDFCIELQIKRDRAYHTELRKNSQDGSYPIDAVFMPVRNVNYSIFSCGNGNEKHEILFLEYGQMEV

SEQ ID NO: 8110 - protein, 227 aa, Zea mays
RTDPYKLSFRLGMRPWIAVAYSAPVAAATAVFLIYPIGQGSFSDGMPLGISGTFNFMIVFQAEHNILMHPFHMLGVAGVFGGSLFSAMHGSLVTSSLIRETTENESANEGYKFGQEEETYNIVAAHGYFGRLIFQYASFNNSRSLHFFLAAWPVVGIWFTALGISTMAFNLNGFNFNQSVVDSQGRVINTWADIINCANLGMEVMHERNAHNFPLDLAALEVPYLNG

SEQ ID NO: 8111 - protein, 263 aa, Zea mays
MNYEFNRFSLAERRIFLAHYQTITYSQTSCGANRFHLPSHGKPFSFRLALSGILVIGSIGTGQSYLVKYLTKNSYFPFIKVRGLLIPQERKHLFILSYTRGFYLEKTMFHTKGFGSITTSSSALDLVALSNEALSISIPHKKSIIETNTIRLALHRQTWGLRAKIRPARDHGTLFYQIGGDLVQNRLLSNNPIDPISIYIKRQSCQEAAFSLAKRYFELGTSMKRLTRLLSLLSFSGGPVAQDLWSSPGTDEKVGRFLWTRSE

SEQ ID NO: 8112 - protein, 226 aa, Zea mays
MGREWELSFRLGMRPWIAVAYSAPVAAATAVFLIYPIGQGSFSDGMPLGISGTFNFMIVFQAEHNILMHPFHMLGVAGVFGGSLFSAMHGSLVTSSLIRETTENESANEGYKFGQEEETYNIVAAHGYFGRLIFQYASFNNSRSLHFLAAWPVVGIWFTALGISTMAFNLNGFNFNQSVVDSQGCVINTWADIINRANLGMEVMHERNAHNFPLDLAALEVPYLNG

SEQ ID NO: 8113 - protein, 177 aa, Zea mays
MPLGTAIHNIEITRGRGGQLARAAGAVAKLIAKEGKLATLRLPSGEVRLVSQNCLATVGQVGNVGVNQKSLGRAGSKCWLGKRPVVRGVVMNPVDHPHGVVKGKPPLVEKNPQPLGVILRLEEELGKGKNIVIVLFFVAVSKYVTRNMENCIFGICNNAMGERRELNSRRWIQNPLP

SEQ ID NO: 8114 - protein, 239 aa, Oryza sativa
MGQKINPLGFRLGTTQNHHSFWFAQPKNYSEGLQEDKKIRNCIKNYIQKNRKKGSNRKIEADSSFEVITHNKKMDSGSSSEVITHIEIQKEIDTIHVIIHIGFPNLLKKKGAIEELEKDLQKEVNSVNQRLNIGIEKVKEPYRQPNILAEYIAFQLKNRVSFRKAMKKAIELTKKTDIKGVKVKIAGRLAGKEIARAECIKKGRLPLQTIRAKIDYCCYPIRTIYGVLGVKIWIFVDEE

SEQ ID NO: 8115 - protein, 124 aa, Brachypodium distachyon
MGQKINPLGFRLGTTQNHHSFWFAQPKNYSEGLQEDKKIRNCIKNYIQKNRKKGSNRKIEADSSFEVITHNKKNGLRLKFRSNYTYRNSKRNRYNPRHNPYWIPQFIKEKRSNRRIRERSTKRS

SEQ ID NO: 8116 - protein, 51 aa, Eragrostis curvula
  misc_feature (22)..(22): Xaa can be any naturally occurring amino acid
  misc_feature (24)..(24): Xaa can be any naturally occurring amino acid
MNPVDHPHGGGEGKAPIGRKKXTXPWGYPALGRRTRKRKKYSDSFILRRRK

SEQ ID NO: 8117 - protein, 225 aa, Zea mays
MGQKDKSTRVSDLVQPKITIPFGSHNQKIILKVYRKIKKIQNCIKNYIQKNRKKGSNRKMESDSSSEVITHIEIQKEIDTIHIIIHIGFANLLKEKGAIEELEKDLQKEVNSVNQRLNIAIEKVKEPYRQPNILAEYIAFQLKNRVSFRKAMKKAIELTKKADIKGIKIQIAGRLAGKEIARAECIKKDRLPLQTIRSKIDYCCYPIRTIYGVLGVKIWISVEEE

SEQ ID NO: 8118 - protein, 165 aa, Zea mays
MLWKKLVQFGKGFFEKKEESTSTDMPLGTAIHNIEITRGRGGQLARAAGAVAKLIAKEGKLATLRLPSGEVRLVSQNCLATVGQVGNVGVNQKSLGRAGSKCWLGKRPVVRGVVMNPVDHPHGGGEGKAPIGRKKPTTPWGYPALGRRTRKRKKYSDSFILRRRK

SEQ ID NO: 8119 - protein, 141 aa, Brachypodium distachyon
MPLGTAMHNIEITRGRGGQLARAAGAVAKLIAKEGKSATLRLPSGEVRLVSQNCLAIVRQVGNVGVNQNSLGRAGSKCWLGKRPIVRGVVMNPVDHPHGGGEGKAPIGRKKPTTPWGYPVLGRRTRKRKKYSDSVILRRRK

SEQ ID NO: 8120 - protein, 165 aa, Sorghum bicolor
MLWKKLVQFGKGFFDKKEESTSTDMPLGTAIHNIEITRGRGGQLARAAGAVAKLIAKEGKLATLRLPSGEVRLVSQNCLATVGQVGNVGVNQKSLGRAGSKCWLGKRPVVRGVVMNPVDHPHGGGEGKAPIGRKKPTTPWGYPALGRRTRKRKKYSDSFILRRRK

SEQ ID NO: 8121 - protein, 165 aa, Oryza sativa
MLWKKLVQFGKGFFERKEESTSTDMPLGTAIHNIEITRGRGGQLARAAGAVAKLIAKEGKSATLRLPSGEVRLVSQNCLATVGQVGNVGVNQKSLGRAGSKCWLGKRPVVRGVVMNPVDHPHGGGEGKAPIGRKKPTTPWGYPALGRRTRKRNKYSDSFILRRRT

SEQ ID NO: 8122 - protein, 166 aa, Oryza sativa
MLWKKLVQFGKGFFERKEESTSTDMPLGTAIHNIEITRGRGGQLARAAGAVAKLIAKEGKSATLRLPSGEVRLVSQNCLATVGQVGNVGVNQKSLGRAGSKCWLGKRPVVRGVVMNPVDHPHGGGEGKAPIGRKIPTTPWGILRLEEELGKKKNIVIVLFFVAVSK

SEQ ID NO: 8123 - protein, 141 aa, Elaeis guineensis
MPLGTAIHNIEITLGKGGQLARAAGAVAKLIAKEGKSATLRLPSGEVRLISKNCLATVGQVGNVGVNQKSLGRAGSKCWLGKRPVVRGVVMNPVDHPHGGGEGRAPIGRKKPTTPWGYPALGRRSRKRKKYSDSFILRRRK

SEQ ID NO: 8124 - protein, 124 aa, Elaeis guineensis
MPLGTAIHNIEITLGKGGQLARAAGAVAKLIAKEGKSATLRLPSGEVRLISKNCLATVGQVGNVGVNQKSLGRAGSKCWLGKRPVVRGVVMNPVDHPHGGGEGRAPIGRKNPQPLGLSCAWKKK

SEQ ID NO: 8125 - protein, 133 aa, Vitis vinifera
MAIHLYKTSTPSTRNRAVDSQVKSNPRNNLIYGQHRCGKGRNARGIITAGHRGGGHKRLYRKIDFRRNEKDIYGRIVTIEYDPNRNAYICLIHYGDGEKRYILHPRGAIIGDTIVSGTEVPIKMGNALPLSAV

SEQ ID NO: 8126 - protein, 2106 aa, Vitis vinifera
MKGHQFKSWIFELREILREIKNSHYFLDSWTQFTSVGSFIHIFFHQERFIKLFDPRIWSILLSRNSQGSTSNRYFTIKGVVLFVVAVLIYRINNRNMVERKNLYLTGLLPIPMNSIGPRNDTLEESFGSSNINRLIVSLLYLPKGKKISESCFLDPKESTWVLPITKKCIMPESNWGSRWWRNWIGKKRDSSCKISNETVAGIEISFKEKDIKYLEFLFVYYMDDPIHKDHDWELFDRLSPRKRRNIINLNSGQLFEILVKHWICYLMSAFREKIPIEVEGFFKQQGAGSTIQSNDIEHVSHLFSRNKWAISLQNCAQFHMWQFRQDLFVSWGKNPHESDFLRNVSRENWIWLDNVWLVNKDRFFSKVRNVSSNIQYDSTRSSFVQVTDSSQLKGSSDQSRDHFDSISNEDSKYHTLINQREIQQLKERSILWDPSFLQTERTEIESDRFPKCLSGYSSMSMSRLFTEREKQMIIHLLPEEIEEFLGNPTRSIRSFFSDRWSELHLGSNPIERSTRDQKLLKKQQDVSFVPSRRSENKEMVNIFKIITYLQNTVSIHPISSDPGCDMVPKDEPDMDSSNKISFLNKNPFFDLFHLFHDRNRGGYTLHHDFESEERFQEMADRFTLSITEPDLVYHKGFAFSIDSYGLDQKQFLNEVFNSRDESNKKSLLVLPPSFYEENESFYRRIRKKWVRISCGNDLEDPKPKIVVFASNNIMEAVNQYILIRNLIQIQYSTYGYIRNVLNRFFLMNRSDRNFEYGIQRDQIGNDTLNHRTIMKYTINQHLSNLKKSQKKWFDPLIFISRTERSMNRDPHAYRYKWSNGSKNFQEHLEHFVSEQKSRFQVVFDRLRINQYSIDWSEVIDKKDLSKSLRFFLSKSLLFLSKLLLFLSNSLPFFFVSFGNIPIHRSEIHIYELKGPNDQLCNQLLESIGLQIIHLKKWKLFLLDDHDTSQKSKFLINGGTISPFLFNKIPKWMIDSFHSRNNRRKSFDNTDSYFSMISHDQDNWLNPVKPFHRSSLISSFYKANRLRFLNNPHRFCFYCNKRFPFYVEKARINNSDFTYGQFLNILFIRKKIFSLCGGKKKHAFLERDTISPIESQVSNIFIPNDFPQSGDETYNLYKSFHFPIRSNPFVRRAIYSIADISGTPLTEGQIVNFERTYCQPLSDMNLSDSEGKNLHQYLNFNSNMGLIHTPCSEKYLPSEKRKKRSLCIKKCVEKGQMYRTFQRDSAFSTLSKWNLFQTYMPWFLTSTGYKYLNLIFLDTFSDLLPILSSSPKFVSIFHDIMYGSDISWRILQKKLCLPQRNLISEISSKCLHNLLLSEEMIHRNNESPLISTHLRSPNVREFLYSILFLLLVAGYLVRTHLLFVSRASSELQTEFEKVKSLMIPSYMIELRKLLDRYPTSELNSFWLKNLFLVALEQLGDSLEEIRGSASGGNMLLGGGPAYGVKSIRSKKKYLNINLIDIIDLISIIPNPINRITFSRNTRCLSHTSKEIYSLIRKRKNVNGDWIDDKIESWVANSDSIDDEEREFLVQFSTLTTEKRIDQILLSLTHSDHLSKNDSGYQMIEQPGAIYLRYLVDIHKKYLMNYEFNTSCLAERRIFLAHYQTITYSQTSCGANSFHFPSHGKPFSLRLALSPSRGILVIGSIGTGRSYLVKYLATNSYVPFITVFLNKFLDNKPKGFLFDDIDIDDSDDIDASDDIDASDDIDASDDIDRDLDTELELLTMMNALTMDMMPEIDRFYITLQFELAKAMSPCIIWIPNIHDLDVNESNYLSLGLLVNYLSRDCERCSTRNILVIASTHIPQKVDPALIAPNKLNTCIKIRRLLIPQQRKHFFTLSYTRGFHLEKKMFHTNGFGSITMGSNARDLVALTNEALSISITQKKSIIDTNAIRSALHRQTWDLRSQVRSVQDHGILFYQIGRAVAQNVLLSNCPIDPISIYMKKKSCNEGDSYLYKWYFELGTSMKKLTILLYLLSCSAGSVAQDLWSLPGPDEKNGITSYGLVENDSDLVHGLLEVEGALVGSSRTEKDCSQFDNDRVTLLLRPEPRNPLDMMQNGSCSIVDQRFLYEKYESEFEEGAGEGALDPQQIEEDLFNHIVWAPRIWRPWGF

SEQ ID NO: 8127 - protein, 141 aa, Amborella trichopoda
MPLGTAIHNIEITLGKGGQLARAAGAVAKLIAKEGKSATLRLPSGEVRLISKNCSATVGQVGNVGVNQKILGRAGSKCWLGKRPVVRGVVMNPVDHPHGGGEGRAPIGRKKPTTPWGYPALGRRSRKKKKYSDSFILRRRK

SEQ ID NO: 8128 - protein, 141 aa, Platanus occidentalis
MGFPKLLIEDRPRGIEELQINLQKEFNSMNRKLNIAITRIAKPYGQPNILAEYIAGQLKSRVSFRKAMKKAIELTEQTDTKGIQVQIAGRIDGKEIARVEWIREGRVPLQTIRAKIDYCSYTVRTIYGVLGIKIWIFVDEE

SEQ ID NO: 8129 - protein, 2304 aa, Amborella trichopoda
MKGHQLKSWIFELREILREIKNSHYFLDSWTKLNLVGSFTHIFFHQERFMKLFDPRIWSILLSCDSQSSTSNRYFTIKGVVLLVVAVLIYRINNRNMVERKNLYLMRLLPIPMNSIGPRNDTLEESFLSSNINRLIVSLLYLPKGKKISESCFMDPKESTWLLPITKKCIMPESNWGSRWWRNRIGKKRDSSCKISNETVAGIEISFKEKDIKYLEFLFVSYTDTDDPIRKDHDLELFDRLSPGKKQNIINLNSGQLFEILVKHLICYLMSAFREKRPIEVEGFFKQQGAEATIQSNDIEHVPRLFSGNKNKWGISLQNCAQFHMWQFHQDLFVSWGKNQHESDFLRNVSRENLIWLGSMWLVNKDRFFSKVRNVSSNIQYDSTRSIFVKVTDSSQLKGSSDQSRDHFNSISNEDSEYHTLIHQTEIEQLKERSILWDPSFLQTERTEIESDRFPKCLSGYFSMSRLFTEREKQMNNHLFPEEIEEFIGNPTRSIRSFFSDRWSELHLGSNATERSTRDQKLLKKQQDVSFVPSRRSENKEMVDIFKIITYLQNTVSIHPISSDPGCDMVPKDEPDMDSSNKISFLNKNPFCDLFHLFHGRNKGGYTLHHDFESEERFQERADLFTLSITEPDLMYHKGFAFSIDSYGLDQKKLLNEVFNSRDESKKKSLLVLPHIFYEENESFYRRIRTKSVRISCRNGLEDPKIVVFASNNIMEAVNQYRLIRNLIQIQYSTYGYIRNVSKRFFLMNRSDRNFEYGIQRDQIGNDTLNHITIMKYTINQHLSNLKKSQKKWFDPLISRTERSMNRDPNAYRYKWSNGSKNFQEHLEHFVSEQKNRFQVVFDRLRINQHSIDWSEVIDKQDLSKSLRFFLSKSLLFLSKSLPFFFVSIGNIPIHRSEIHIYELKGPNDQLCNQLLESIGVQIVHLNKLKPFLLDDHDTSQRSKLLINGGTIARFWFNKIPKWMIDSFHTRNNRGKSFENTDSYFSMISHDRDNWLNPVKPFHRSSLISSFYKANQLRFLNNPHHFWFYCNKRFPFYAEKTRINNYDLTYGQFLNISFIRNKIFSLCVGKKKHVFLERDTISPSPIESQVSDIFIPNDFPQSGDETYNLYKSFHFPTRSDPFVRRAIYSIADISGTPLTEEQRVNFEGTYCQPLSDLNLSDSEGKNLHQYLSFNSNMGLIHTPCSEKYLPSGKRKKRNLCLNKCVEKRQMYRTFQRDSAFSNISKWNLFQTYMPWFLTSTGCKYINFILLDTFSDPLPILSSSHKFVSIFHDIMHGSAWSIPQKKLRAILPQWNLISEISSKCLQNLLLSEEMIHRNNESPVPLIWTHLRSPNPREFFYSSLFLLLVAGYLVRTHLLFVSRVSSELHTELEKIKSLMIPSYMMELRKLLDSYPPPELNSFWLKNLFLVALEQLGDSPEEIRGSDSGGNMLLGGGPAYGVKSIRSKKKDLNINLIDIIDLISIIPNPVNPITFSINTRRLSRTSKEIYSLIRKRKNVNSDWIDGKIESWVANSDLIDDEEREFLVQFSALTTEKRIDQILWSLTHSDPFSKNDSGYQMIEQPGSIYLRYLVDIHKKYLMNSEFNRSCLAERRIFLAHYQTITYSQTSCGANSSHFPSHGKPFSLRLDLSPSRGILVIGSIGTGRSYLVKYLATNSYLPSITVSPNKFLDDKPKGYLIDDIDDSDDIDLDDSNSIDDSDDVDIGDSDDIDIDDDLDAELLTMTNVLTMYMTPKMDRFDITPQLELAKAMSPCIIWIPNIHDLYVNESNYLSLGLLVNHLSRDCERCSTRNILVIASTHIPQKVDPALIAPNKSNTCIKIRRLLIPQQRKHFFILSYTRGFHLEKKMFHTNGFGSITMGSNARDLVALTNEALSISITQKKSIIDTNTIRSALHRQTWDLRSQVRSVQDHGILFYQIGRSFAQNVLLSNCSIDPISTYMKKKSCKEGDSYLYKWYFELGTSIKKLTTLLYLLSCSAGSVAQDLWSPPGPDEKNWITSYGFVENDSDLVHGLLEGALVGSSRTEKDCSQFDNDRVTLLLRSEPRNPLDMMQNGSCSIVDQRFLYEKYESEFEEGEGEGTLDPQQIEEDLFNHIVWAPRIWRPCGNLFDCIERPNESRFPYRSRSFRGKQIISHKEDELQENDLEFLQSGTMQYQTRDRSSKEQGFFQISQFIWDPADPFFFLFKDQPFVSVFARREFFADEEMSKGLITSQTHSPTSIYERWLIKNTQEKHFELLIHRQRWLSTNSSLSNGSFRSNTPSESYQYLSNLFLSNGTLLDQMAKTLLRKRWLFPDEMKHLIHVTGERFPIP

SEQ ID NO: 8130 - protein, 62 aa, Amsonia hubrichtii
MMTLGCTKSETKWIYFLSHIPPLLYISRYVIAVCLFFHLGFFNESISTYLSSKDISFITIVI

SEQ ID NO: 8131 - protein, 142 aa, Malus domestica
MPLGTAIHNIEITLGKGGQLARAAGAVAKLIAKEGKSATLKLPSGEVRLISKNCSATVGQVGNVGVNQKSLGKAGSKCWLGKRPVVRGVVMNPVDHPHGGGEGRAPIGRKKPATPWGYPALGRRSRKRNKYSDNLILRRRSK

SEQ ID NO: 8132 - protein, 331 aa, Malus domestica
MVREKVTVSTRTLQWKCVESRADSKRLYYGRFILAPLMKGQADTIGIAMRRALLGEIEGTCITRAKSEKIPHEYSTIVGIQESVHEILMNLKEIVLKSNLYGTRNASICVKGPGYVTAQDIILPPSVEIVDNTQYIANLTEPINLCIELQIERNRGYRIKTPNNFQDGSYPIDAVFMPVRNANHSIHSYVNGNEKQEILFLEIWTNGSLTPKEALHEASRNLINLFIPFLHAEEENLHLENNQHKVTLPLFTYHDRLAKQRKNKKEIALKYIFIDQSELLPRVYNCLKRSNIHTLLDLLNNSQEDLMKMKHFRIEDVKHILNILEIKKHFE

SEQ ID NO: 8133 - protein, 133 aa, Tragopogon dubius
MAIHLYKTSTPSTRNGTVDSQVKSNPRNNLIYGQRHCGKGRNARGIITAGHRGGGHKRLYRKIDFRRNEKDIYGRIVTIEYDPNRNAYICLIHYRDGEKRYILHPRGAIIGDTIVSGTEVPIKMGNALPLSAV

SEQ ID NO: 8134 - protein, 142 aa, Tropaeolum majus
MPLGTAIHNIEITLGKGGQLARAAGAVAKLIAKEGKSATLKLPSGEVRLISKNCSATVGQVGNVGVNQKSLGRAGSKCWLGKRPVVRGVVMNPVDHPHGGGEGRAPIGRKKPATPWGYPALGRRSRKRNKYSDNLILRRRSK

SEQ ID NO: 8135 - protein, 122 aa, Medicago truncatula
MAIHLYKTSIPSTRTRNRLIYGQHHCGKGRNARGIITAGHRGGGHKRLYRKIDFRRNEKDIYGRIVTIEYDPNRNAHICLIHYGDGEKRYILHPRGAIIGDTIVYGTEVPIKMGNALPLSAV

SEQ ID NO: 8136 - protein, 116 aa, Elaeis guineensis
MPLGTAIHNIEITLGKGGQLARAAGAVAKLIAKEGKSATLRLPSGEVRLISKNCLATVGQVGNVGVNQKSLGRAGSKCWLGKRPVVRGVVMNPVDHPHGGGEGRAPIGRKNPQPLG

SEQ ID NO: 8137 - protein, 142 aa, Rhizophora mangle
MPLGTAIHNIEITLGKGGQLARAAGAVAKLIAKEGKSATLKLPSGEVRLISKNCSATVGQVGNAGVNQKSLGRAGSKCWLGRRPVVRGVVMNPVDHPHGGGEGRAPIGRKKPATPWGYPALGRRSRKRNKYSDNLILRRRSK

SEQ ID NO: 8138 - protein, 136 aa, Ricinus communis
MAIHLYKTSTPSTRNGAVDSQVKSNTRNTRNNLIYGQHRCGKGRNARGIITARHRGGGHKRLYRKIDFRRNEKDIYGRIVTIEYDPNRNAYICLIHYGDGEKRYILHPRGAIIGDTIISGTEVPIKMGNALPLSAV

SEQ ID NO: 8139 - protein, 154 aa, Unknown
  Sequence found in Organisms: Zea mays, Sorghum bicolor
MGNALPLKSTSTDMPLGTAIHNIEITRGRGGQLARAAGAVAKLIAKEGKLATLRLPSGEVRLVSQNCLATVGQVGNVGVNQKSLGRAGSKCWLGKRPVVRGVVMNPVDHPHGGGEGKAPIGRKKPTTPWGYPALGRRTRKRKKYSDSFILRRRK

SEQ ID NO: 8140 - protein, 124 aa, Cucurbita pepo
MPLGTAIHNIEITLGKGGQLARAAGAVAKLIAKEGKSATLKLPSGEVRLISKNCSATVGQVGNAGVNQKSLGRAGSKCWLGKRPVVRGVVMNPVDHPHGGGEGRAPIGRKNPQPLGLSCTWKKK

SEQ ID NO: 8141 - protein, 116 aa, Prunus persica
MAIHLYKISTPSTRNGAVDSQSNPRNNLIYGQHRCGKGRNARGIITAGHRGGGHKRLYHKIEFRRNEKDIYGRIVTIEYNPNRNAYICLIHYGDGEKRYILHPKGAIIGDTIVYGT

SEQ ID NO: 8142 - protein, 72 aa, Zea mays
MPLGTTIHNIEITRGRGGQLARAAGAIAKLIAKEGKLATLRLPSGEVRLVSQNCLATFGQVGNVGVNQKSFG

SEQ ID NO: 8143 - protein, 101 aa, Salvia sclarea
MPLGTAIHNIEITLGKGGQLVRAAGAVAKLIAKEGKSATLKLPSGEVRLISKNCSATVGQVGNVGANQKSLGRAGSKRWLGKRPVVRGVVMNPVDHPHGGW

SEQ ID NO: 8144 - protein, 142 aa, Citrullus lanatus
MPLGTAIHNIEITLGKGGQLARAAGAVAKLIAKEGKSATLKLPSGEVRLISKNCSATVGQVGNAGVNQKSLGRAGSKCWLGKRPVVRGVVMNPVDHPHGGGEGRAPIGRKKPATPWGYPALGRRSRKRNKYSDNLILRRRSK

SEQ ID NO: 8145 - protein, 337 aa, Solanum lycopersicum
MVREKVTVSTRTLQWKCVESRTDSKRLYYGRFILSPLMKGQADTIGIAMRRALLGEIEGTCITRVKSEKVPHEYSTITGIQESVHEILMNLKEIVLRSNLYGTSEASICVKGPGYVTAQDIILPPYVEIVDNTQHIASLTEPIDFCIGLQIERNRGYLIKTPHNFQDGSYPIDAVFMPVRNANHSIHSYGNGNEKQEILFIEIWTNGSLTPKEALHDASRNLIDLFIPFLHMEEDNLYLQDNQHTVPLSPFTFHDKLAKLIKNKKKIALKSIFIDQSELSSRIYNCLKMSNIYTLLDLLNNSQEDLMKIEHFRSEDIKQILDILEKYFVIDLAKNKF

SEQ ID NO: 8146 - protein, 134 aa, Momordica charantia
MPLGTAIHNIEITLGKGGQLARAAGAVAKLIAKEGKSATLKLPSGEVRLISKNCSATVGQVGNAGVNQKSLGRAGSKCWLGKRPVVRGVVMNPVDHPHGGGEGRAPIGRKNPQPLGVILHLEEEVEKGINIVII

SEQ ID NO: 8147 - protein, 241 aa, Papaver somniferum
MKRHQFKSWIFELREILREIKNSHYFLDSWTKFDSVGSFTHIFFHQERFMKLFDPRIWSILLSRDSQGSTSNRYFTIKGVVLLVVAVLIYRINNRNMVERKNLYLMGLLPIPMNSIGPRNDTSEESFWSSNINRLIVSLLYLPKGKNISESCFMDPKESTWVLPITKKCIMPDSNWGSRWWRNRIGKRWNSSCKISKETVAGIEISFKEKDIKISGVSFLYPIRMIRSARTMIGNCLIVFL

SEQ ID NO: 8148 - protein, 332 aa, Euphorbia peplus
MVREKVTISTRTLQWKCVESRKDNKRLYYGRFILSPLMKGQSDTIGIAIRRALLGEIEGTCITRAKFEKISHEFSTITGIQESIHEILMNLKEIILRSNLYGTCDASICVKGPGYVTAQDIILPPFVEIIDNTQHIASLTEPIDLCIRLQIERNRGYRIKPTKTFQDGSFPLDAVFMPVRNANHSVHSYGNGNEKQEMLFLEIWTNGSLTPKEALHEASRNLIDLFIPFLHADEQNLPLEKNQHNVTLPLFIFHDRLTKLIKKKRIPLKYIFIDQFELTPKIYNCLKRSNIHTLSDLLNKSQEDLIQIEDFHIDDVKHILGILEIKKNFVME

SEQ ID NO: 8149 - protein, 142 aa, Capsicum annuum
MPLGTAIHNIEITLGKGGQLARAAGAVAKLIAKEGKSATLKLPSGEVRLISKNCSATVGQVGNVGVNQKSLDRAGSKRWLGKRPVVRGVVMNPVDHPHGGGEGRAPIGRKKPTTPGGYPALGRRSRKRNKYSDNLILRRRSK

SEQ ID NO: 8150 - protein, 142 aa, Brassica rapa
MPLGTAIHNIEITLGKGGQLARAAGAVAKLIAKEGKSATLKLPSGEVRLISKNCSATVGQVGNVGVNQKSLGRAGSKCWLGKRPVVRGVVMNPVDHPHGGGEGRAPIGRKKPVTPWGYPALGRRTRKRKKYSETLILRRRSK

SEQ ID NO: 8151 - protein, 327 aa, Brassica rapa
MVREKVKVSTRTLQWKCVESRRDSKRLYYGRFILSPLMKGQADTIGIAMRRALLGEIEGTCITRAKSENIPHDYSNIVGIQESVHEILMNLNEIVLKSNLYGTRNALICVQGPGYITARDIVLPPSVEIVDNTQHIATLTEPINLCIGLKIERNRGYSLKMSNNFEDRSYPIDAVFMPVQNANHSIHSYGNGNEKQEILFLEIWTNGSLTPKEALHEASRNLINLFIPFLHVEEETFYLENNQHQVTLPLFPFHNRLVNLRKKKKELAFQYIFIDQLELPPRIYNCLKKSNIHTLLDLLNNSQEDLIKMEHFHIEDVKKILDILEKK

SEQ ID NO: 8152 - protein, 218 aa, Brassica juncea
MGQKINPLGFRLGTTQSHHSIWFAQPKKYSEGLEEDKKIRDCIKNYVQKNIRISSGMEGIARIEIQKRIDLIQIIIYMGFPKLLIEDKPRRIEELQMNVQKELNCVNRKLNIAITRISNPYGHPNILAEFIAGQLKNRVSFRKAMKKAIELTEQANTKGIQVQIAGRIDGKEIARVEWIREGRVPLQTIEAKIDYCSYTVRTIYGVLGIKIWIFVDEE

SEQ ID NO: 8153 - protein, 274 aa, Brassica oleracea
MVREKVKVSTRTLQWKCVESRRDSKRLYYGRFILSPLMKGQADTIGIAMRRALLGEIEGTCITRAKFENIPHDYSNIVGIQESVHEILMNLNEIVLKSNLYGTRNALICVQGPGYITARDIVLPPSVEIVDNTQHIATLTEPINLCIGLKIERNRGYSLKMSNNFEDRSYPIDAVFMPVQNANHSIHSYGNGNQKQEILFLEIWTNGSLTPKEALHEASRNLINLFIPFLHVEEETFYLENNQHQVTLPLFPFHNRLVNLRKKKKRTSVSIYFY

SEQ ID NO: 8154 - protein, 133 aa, Unknown
  Sequence found in Organisms: Brassica napus, Brassica rapa
MAIHLYKTSTPSTRNGAVDSQVKSNPRNNLIYGQHHCGKGRNARGIITVRHRGGGHKRLYRKIDFRRNTKDIYGRIVTIEYDPNRNAYICLIHYGDGEKRYILHPRGAIIGDTIVSGTEVPIKMGNALPLSAV

SEQ ID NO: 8155 - protein, 788 aa, Sorghum bicolor
MIPARHMPPMIVRNSAAAYGSSSALSLSQPNLLDSQQQLQLQQALQQQHLLDQIPATTAESGDNMGRSGGGRGSDPLMGGDEFESKSGSENVDGVSVDDQDPNQRPSKKKRYHRHTQHQIQEMEAFFKECPHPDDKQRKELSRELGLEPLQVKFWFQNKRTQMKNQHERHENSQLRAENEKLRAENMRYKEALSSASCPNCGGPAALGEMSFDEHHLRVENARLREEIDRISAIAAKYVGKPMVSFPVLSSPLAGARPSPLDIGGGVGGAAAYGAVDMFGGGVAVDLLRGAVPQSDADKPMIVELAVTAMEELVRMAQLDEPLWNAPGLDGSAETLNEEEYAHMFPGGLGPKQYGFKSEASRDSSVVIMTHANLVEILMDVNQYATVFSSIVSRAVTLEVLSTGVAGNYNGALQVMSVEFQVPSPLVPTRESYFVRYCKQNADGSWAVVDVSLDSLRPNSVLKCRRRPSGCLIQEMPNGYSKVTWVEHVEVDDRSVHNIYKLLVNSGLAFGPPRWVGTLDPQCEPLPSVMPSTIPTSDMGVITSTEGRKSMLKLAERMVMSFCGGVTASAAHQWTTLSGSGAEDVRVMTRKSVDDPGRPPGIVLNAATSFWLPVPPKRVFDFLRDESSRSEWDILSNGGVVQEMAHIANGRDHGNCVSLLRVNSTNSNQSNMLILQESCTDASGSYVIYAPVDVVAMNVVLNGGDPDYVALLPSGFAILPDGPAGSNMQGDGGVGSGGSLLTVAFQILVDSVPTAKLSLGSVATVNSLIACTVERIKAAVSGESNPQQ

SEQ ID NO: 8156 - protein, 318 aa, Secale cereale
MKSSSNLEAFLQAATPLLPWRSATMERFQGAPSSVWQQPDGKNKDAVEYFALSDLWEHYAESSAYGLAVPVRDAGDRGALVTTQHFVPYLSAVQLYTATKPTSHTLGATSRSTGSETDSWSDDSVGGDRFASSGSSSWDAASDEDDSSSTYDGNGSTGVSAKQSGYLNFQYREWDSPYERVPLAHKVAELAQDYPCLTSLSSAELSPSSWMSVAWYPIYHIPAHVNLKGTSACFLTYHSLSSVFQDNIHSGPEHDDGEIAALSPFGLATYRMQGDLWRRPGSSDPRRLSELHWAASSWLKQVGAHHPDFTFFTSSHRR

SEQ ID NO: 8157 - protein, 316 aa, Triticum aestivum
MKSSSNLEAFLQAATPLLPWRSTTMERFQGAPSSVWQQPDGKSKDAVEYFALSDLWEHYAESSAYGLAVPVRDAGDRAVVTTQHFVPYLSAVQLYTATKPTTHTLGATSRSTGSETDSWSDDSVGDRFAGSGSSSWDAASDEDDSSSTYDGNGSTGVSVKQSGYLNFQYREWDSPYERVPLAHKVAELAQDYPCLLSLSSAELSPSSWMSVAWYPIYHIPAHVNLKGTSACFLTYHSISSVFQDNIHSGPEHGEGEIAALSPFGLATYRMQGDLWKRPGSSDYRRLSELHWAAASWLKQVGAHHPDFTFFTSSHRR

SEQ ID NO: 8158 - protein, 282 aa, Secale cereale
MAAAAARSGSRRLFSISALLPPKPPTPPPKADPFASLFVPGLSKRTTTDGLREAFAKSGEVAHASSVKNSRWYMINANRSGPLTVRKEYRKVLPSFIRPSASYSTEASGKRPKQERTDLTTVEDPFSAPTYNIPEKPVTFVEGASYSVVILAGLGVAALAGYAVLKELIFEPKEYKIFGKALARVQSDSQVTAKIGYPITGYGTESRNRAARQRIQNRVWTDEDGVEHVEVGFHIRGPHGAGKVFAEMFKDSSDRTWKFTFLLVEITSPRPAQIMLESYLPA

SEQ ID NO: 8159 - protein, 216 aa, Picea glauca
MSKLQSDVLREAISQVMADSKEKQRKFTETIELQIGLKNYDPQKDKRFSGSVKLPHIPRPKMKVCMLGDAQHIEEAEKISLDYMDVEGLKKMNKNKKLVKKLAKKYHAFLASEAIIKQIPRLLGPGLNKAGKFPTLVSHQESLESKVNETKATVKFQLKKVLCMGVAVGNCGMEEKQVFQNVQLSVNFLVSLLKKNWQNVRCLYLKSTMGKPARVF

SEQ ID NO: 8160 - protein, 216 aa, Picea glauca
MSKLQSDVLREGITQVMGESKDKKRKFTETIELQIGLKNYDPQKDKRFSGSVKLPHIPRPKMKVCMLGDAQHIEEAEKISLDYMDVEGLKKMNKNKKLVKKLAKKYHAFLASEAIIKQIPRLLGPGLNKAGKFPTLVSHQESLESKVNETKATVKFQLKKVLCMGVAVGNCGMEEKQVFQNVQLSVNFLVSLLKKNWQNVRCLYLKSTMGKPARVF

SEQ ID NO: 8161 - protein, 216 aa, Pinus taeda
MSKLQSDVLREGISQVMGESKDKKRKFTETIELQIGLKNYDPQKDKRFSGSVKLPHIPRPKMKVCMLGDAQHVEEAEKISLDYMDVEGLKKMNKNKKLVKKLAKKYHAFLASEAIIKQIPRLLGPGLNKAGKFPTLVSHQESLEAKVNETKAMVKFQLKKVLCMGVAVGNCGMEEKQVFQNVQLSVNFLVSLLKKNWQNVRCLYLKSTMGKPARVF

SEQ ID NO: 8162 - protein, 215 aa, Pseudotsuga menziesii
SKLQSDVLREGISQIMGESNDKKRKFTETIELQIGLKNYDPQKDKRFSGSVKLPHIPRPKMKVCMLGDAQHVEEAEKISLDYMDVEGLKKMNKNKKLVKKLAKKYHAFLASEAIIKQIPRLLGPGLNKAGKFPTLVSHQESLESKVNETKATVKFQLKKVLCMGVAVGNCGMEEKQVFQNVQLSVNFLVSLLKKNWQNVRCLYLKSTMGKPARVF

SEQ ID NO: 8163 - protein, 255 aa, Picea glauca
MSKLQSDVLREGITQVMGESKDKKRKFTETIELQIGLKNYDPQKDKRFSGSVKLPHIPRPKMKVCMLGDAQHIEEAEKISLDYMDVEGLKKMNKNKKLVKKLAKKYHAFLASEAIIKQIPRLLGPGLNKAGKFPTLVSHQESLESKVNETKATVKFQVEKSSMYGGCCGELWNGGETGVSECSIECELSGILAEEKLAKCPMLVSEEYHGQASTRILSFAILVSACVGCIWRRFFLGFCFALVRTLHFCLCGGVC

SEQ ID NO: 8164 - protein, 73 aa, Cedrus atlantica
MSKLQSDVLREGITQIMGESKDKKRKFTETIELQIGLKNYDPQKDKRFSGSVKLPHITPPKDEGLHARRCPTY

SEQ ID NO: 8165 - protein, 216 aa, Abies balsamea
MSKLQSDVLREGITQIMGESKDKKRKFTETIELQIGLKNYDPQKDKRFSGSVKLPHIPRPKMKVCMLGDAQHVEEAEKISLDYMDVEGLKKMNKNKKLVKKLAKKYHAFLASEAIIKQIPRLLGPGLNKAGKFPTLVSHQESLEFKVNETKATVKFQLKKVLCMGVAVGNCGMEEKQVFQNVQLSVNFLVSLLKKNWQNVRCLYLKSTMGKPARVF

SEQ ID NO: 8166 - protein, 216 aa, Pinus pinaster
MSKLQSDVLREGITQVMGESKDKKRKFTETIELQIGLKNYDPQKDKRFSGSVKLPHIPRPKMKVCMLGDAQHVEEAEKISLDYMDVEGLKKMNKNKKLVKKLAKKYHAFLASEAIIKQIPRLLGPGLNKAGKFPTLVSHQESLEAKVNETKAMVKFQLKKVLCMGVAVGNCGMEEKQVFQNVQLSVNFLVSLLKKNWQNVRCLYLKSTMGKPARVF

SEQ ID NO: 8167 - protein, 255 aa, Picea glauca
MSKLQSDVLREGITQVMGESKDKKRKFTETIELQIGLKNYDPQKDKRFSGSVKLPHIPRPKMKVCMLGDAQHIEEAEKISLDYMDVEGLKKMNKNKKLVKKLAKKYHAFLASEAIIKQIPRLLGPGLNKAGKFPTLVSHQESLESKVNETKATVKFQLKKVLCMGVAVGNCGMEEKQVFQNVQLSVNFLVSLLKKNWQNVKVLIFEDYHGKPNRISECGTEWRYFNGTSFCITIKHRLCYLVSTKQINLMQLLTN

SEQ ID NO: 8168 - protein, 198 aa, Picea glauca
MTPKRTSVSVGPVKLPHIPRPKMKVCMLGDAQHIEEAEKISLDYMGVEGLKKMNKNKKLVKKLAKKYHAFLASEAIIKQIPRLLGPGLNKAGKFPTLVSHQESLEGKVNETKATVKFQLKKVLCMGVAVGNCGMEEKQIFQNVQLSVNFLVSLLKKNWQNVRCLYLKTTMGKPNRISEFCNIGVSLCWLHMERIFPWF

SEQ ID NO: 8169 - protein, 216 aa, Zostera marina
MSKLQSDVLREAIGQITAACSDKKRNFTETIELQIGLKNYDPQKDKRFSGSVKLPHIPRPKMKVCMLGDAQHVEEASKISLSSMSVEDLKKFNKNKKLVKKMSKKYHAFLASEAVIKQIPRLLGPGLNKAGKFPTLVSHQESLEAKVNEIKATVKFQLKKVLCMGVAVGNVGMDEKQIFQNVQLSVNFLVSLLKKNWQNVKCLHLKSTMGKPFRLF

SEQ ID NO: 8170 - protein, 155 aa, Picea glauca
MKVCMLGDAQHIEEAEKISLDYMDVEGLKKMNKNKKLVKKLAKKYHAFLASEAIIKQIPRLLGPGLNKAGKFPTLVSHQESLESKVNETKATVKFQLKKVLCMGVAVGNCGMEEKQVFQNVQLSVNFLVSLLKKNWQNVRCLYLKTTMGKPNRIF

SEQ ID NO: 8171 - protein, 162 aa, Setaria italica
MYPAKPSDAAAAAPVTGVPVGGPPVAAGNATSQWSSGLFDCFDDCGLCCLTCWCPCITFGRVAEIVDRGATSCGTSGALYALLAYLTGCQWIYSCTYRSKMRAQFGLPENPCCDCCACALCQQYKELKARGFDPELGWDLNAQRGAGAGQAMYAPAAQGMGR

SEQ ID NO: 8172 - protein, 320 aa, Pennisetum glaucum
MARKCSSCGNNGHNSRTCGGHGRVLMENGGGGGGVRLFGVQLHVGSPSSPMKKCFSMDCLSSAAPAAYYAAALAASSSSPSVSSSSSLVSVEENAEKVATNGYLSDGLMGRAQERKKGVPWTEDEHRRFLAGLEKLGKGDWRGISRHFVTTRTPTQVASHAQKYFLRQGSLTHKKRRSSLFDVVENADRAATSASERPRLRGAAAGSSAPPDTELPALSLGITSRPAKQPERVLPPSLSSPLQLPRCSSAMSSGSGSTSPCLAAPRQQKHPASSLTLPKPHQVSLHQLAPPDLELKISTPTDHQAGSSPRTPFFGTIRVT

SEQ ID NO: 8173 - protein, 510 aa, Setaria italica
MASLPLHLLLLLPLLAVVSFLWLHRAVSRRRGRGGGARLPPSPWALPVIGHLHHLAGALPHRAMRNLAARHGELMLLRLGGLPVVVASSADAAREVMRARDLDFATRPVTRMVRLVIPDGAEGIIFAPYGGGWRQTRRICTVELLSARRVQSFRPVREEEAGRLLRAVASAAPPAWAVNLSELLSVYAADSSVRAIIGSRFKDRDTFLAMLERGLKLFAKLSLPDLFPSSRLAMLVSRMPGRMKQHRQETVVFMDALVRDHEESRAADDGDGKEDLLDVLLRIQTEGDLPVPLTTDNIKSVVGDMFAGGSETAATALQWIMAELMRNPRVMQKAQDEVRRALAGRQTVTEDDLGDLHYMRLVIKEALRLHPPLPLLLPRECRNSCQVLGFDVPAGTIVFVNAWAIARDPKYWDKPEEFVPERFEDGKIDFKGTDFEFIPFGAGRRMCPGMAFGLVHLELALAGLLYHFDWELPLGMEAADLDMTEEMGVTARRLQDLRLVPVVRVPVPVE

SEQ ID NO: 8174 - protein, 512 aa, Sorghum bicolor
MELVALPVHLLLPLPILAVVSFLWLRRAVLGRRGGGPRLLPSPWALPVIGHLHHLAGALPHRAMRDLAARHGPVMLLRLGGLPVVVASSADAAREVMKARDIEFATRPVTRMARLVIPEGAEGIVFAPYGDGWRQTRKICTVELLSARRVQSFRPVREDEARRLLHTVASAPRPRAVNLSELLAVYAADSSVRAIIGSRIKDRDTFLALLERGLKLFGSMSLPDLYPSSRLAMLVSRMPRRMKQHRQEADAFMDAMVREHGESRAANDDDDDKEDLLDVLLRIQREGGLQFPLTTDNIKTVIGDMFAGGSETGATTLQWIMAELMRNPRVMKKAQDEVRRALAVAGRQRVTEDDLSNLHYMRLVIKEGLRLHPPLPLLLPRECRSSCQVLGFDVPAGTVVFVNAWAIGRDPSSWDKPEEFVPERFEGSGVDFKGTDFEYVPFGAGRRMCPGMAFGLVTMELALASLLYHFDWELPPGMTATDVDMTEEMGVTARRLHDLLLVPFVRMPVPMT

SEQ ID NO: 8175 - protein, 1248 aa, Sorghum bicolor
MYGICAQRSDGKVLNCANATKAVKPDTLFSSRIQSLCPTITGDVCCTVDQFDTLHQQVQQAVPFLVGCPACLRNFLNLFCEMSCSPNQSLFINVTSVKQINSTMTVDGLDYYVTTNYGEELYDSCKDVKFGTLNTRAMDFIGAGAKTYKDWLAFIGRQANSNEPGSPYLITFRSDFSDSSGVKPLNSTIYSCGDPSLGCSCGDCPSSSECTGSLLPQLNTETSCSVKMGSLKAKCLDFSLVVIYLALLCAFLLWGLLHRTRGRTAFGQTRPLRNSDNKSDSNKNGKSPHNSVQVPEAASSTVKPSNPSIVQAYMSIFFRKHGIFVARHPLLVLCVSLLVPVLLCIGLFRFKVETRPEKLWVSPGSQAADEKNYFDSHLAPFYRIEQLVLATSASGGSEAPSIVNDNNMKLLFDVQKKVDDLRVNYSGSTVALADICLKPLSTDCATQSVLQYFQLDPKKFDDSGIDHAKFCFQHYTSEETCLSTFQSPIDPSTILGGFLGSNFTEASAFVITYPVNNKVETTGKENGKAVAWERAFINLVKLANPALIFQLGYLRICHPSRIREEIRPMVLAQNLTLSFSSESSIQDELNRESTADAITIVISYIVMFAYISFTLGDRPSRWLLLFVSSKVLLGLSGVVLVMLSVLGSMGFFSAIGVKSTLIIMEVIPFLVLARFSLTLSMSTNNSEYLDFSEQINKANSTAISPSYFIHIAVVTTLCLFYWKALAVFMDFLLQVTAFVALIVFDFRRAQDGRIDCVPCARIMPSTGAGDGGDEQRLHLLARYMRDIHGPILSYRAVKFVVVTVFLGLTFASIALSTRLQPGLEQQIVLPRNSYLQDYFDDLAKYMKVGPPLYFVVKDFNYSSASVHTNQICSINQCNSNSLLNEISRQSLSPETSYIAKPAASWLDDFLVWMSPEAFGCCRKFVNGNYCPPDDQPPCCQHNQVSGSCVTSSTCSNCTTCFLHSDLDNGRPSTTQFRDKLPWFLDALPSSDCSKGGKGAYSTSLDLSGYESGIIQASAFRTYHTPLNKQSDYVNSMRAARDFSSKMSKDLQMNIFPYSVFYIFFEQYLSVWKTAIMNICVCLGTIFVVCFIVTGSLWASAIILIVLAMIVLDLMGVMAILGIQLNAIAVVNLVMSIGIAVEFCVHITHAFMIGAGDRETRARQALSTMGASVFSGITLTKLVGVIVLRFAKSEVFVVYYFQMYLALVIIGFLHGLIFLPVVLSLCGPPPKSAKPIEQSQPPSASTERT

SEQ ID NO: 8176 - protein, 1215 aa, Brachypodium distachyon
MYGICAHRSDGKVLNCVNATKAVKPDALFSTRIQSLCPTITGDVCCTVDQFDTLHQQVQQAVPFLVGCPACLRNFLNLFCEMSCSPNQSLFINVTSAKQVNKTMTVDGIDYYVTSNYGEELYSSCKDVKFGTLNTRAMDFLGGGAKTYKEWFTFLGRQANPNEPGSPYLITYRSDFDQSSRVKPLNATIYSCGDPSLGCSCGDCPSSSVCTGSLLPQSKTVTSCSVNMVSLKAECLDFSLVIVYLALLCAILLWGLLYRRRGRTGFSSQTKTPKNSEDKLHSNNNDNVPDNHVQVPEATSSSVVQTYMSTFFRRHGIFVTRHPLLVLFASILVPVILCIGLIRFKVETRPEKLWVSPGSRAADEKQYFDSHLAPFYRIEQLVLATSASDQSEAPTIVNENNMKLLFQIQNKVDDLRANYSGSTVSLADICLKPLSTDCATQSVLQHYSSEETCLSTFQSPIDPSTILGGFPGSNFSEASAFIITYPVNNKVETTGQENGKAVAWERAYINLVKDEILPMVLAQNLTLSFSSESSIQDELNRESTADAITIVISYIVMFAYISFTLGDRPSRLWSLLVSSKVLLGLSGVVLVMLSVLGSIGFFSAIGMKSTLIIMEVIPFLVLAVGVDNMCILVHAVKRQPYGLVLEERVSNALVEVGPSITLASLAEVLAFAVSAINPMPATRVFSIFAAMAVLLDFLLQVTAFVALIVLDFRRAEDGRIDCVPCARLTSSTDTVAGDGSPHQGPHLVARYMKDIHGPILGYRAVKFIVIAAFVGLAFASIAMTTRLQPGLEQQIVLPRNSYLQGYFNDLEKYMKVGPPLYFVVKDFNYSSASENTNQICSINQCNSNSLSNEIARQSLSPETSYIAKPAASWLDDFLVWMSPEAFGCCRKFVNGNYCPPDDQPPCCQLDQDSGSCSPNGSCNNCTTCFLHSDLQNGRPSTTQFREKLPWFLDALPSSDCSKGGKGAYSTSLNLSGYESGIIQASAFRTYHTPLNKQTDYVNSLRAARDFSSQVSKDLQMQIFPYSVFYIFFEQYLGIWKTAIMHICVCLGTVFVVCFLLTSSLWASAIILVVLAMIVLDLMGVMAVLGIQLNAISIVNLVMSIGIAVEFCVHITHAFMIGIGDRENRARHALSTIGASVFSGITLTKLVGVIVLRFAKSEVFVVYYFQMYLALVLIGFLHGLIFLPVVLSLCGPPQKTMKPIEQSQTPPSNGQT

SEQ ID NO: 8177 - protein, 1318 aa, Oryza sativa
MYGICAQRSDGKVLNCVNATKAVKPDTLFSARIQSLCPTITGDVCCTVDQFDTLHQQVQQAIPFLVGCPACLRNFLNLFCEMSCSPNQSLFINVTSVKQVNNTMTVNGIDYYVTSTYGEELYNSCKDVKFGTLNTRAMDFLGGGAKNYKEWMAFIGRQADLNQIGSPYLITFPSDISGSTAVKPLNATIYSCGDPSLGCSCGDCPSSSVCTGSLLPQLNTETSCSVKMGSLKAKCLDFSLVVVYLVLLCIFLFGAFLHRTRRSGIFSHTKPLKNAEDKIHSSNNGKVPDSSAQVSEAASAPVQSAHPSVIQTYMSTFFRKHGTFVAKHPLLVLFVSLLVPTLLCIGLIRFKVEIRPEKLWVSSGSRAADEKQYFDSHLAPFYRIEQLVLATSAFGGSEAPTIVNDNNMKLLFQIQKKIDDLRANYSGSTVSLADICLKPLGTECATQSVLQHYTTEETCLSTFQSPIDPSTILGGFPGNNFTEASAFVITYPVNNKVETTGQENGKAVAWERAYVNLVKEEILPMVLAHNLTMSFSSESSIQDELNRESTADAITIVISYIVMFAYISFTLGDRPSHLLSLFVSSKVLLGLSGVVLVMLSVLGSMGFFSAIGVKSTLIIMEVIPFLVLAVGVDNMCILVHAVKRQPDGLDLEERISTALVEVGPSITLASLAEVLAFAVSAINPMPATRVFSMFAALAVLLDFLLQVSAFVALIVLDFRRAQDGRIDCMPCARVKSSVVASDGGNHQGLPLLARYMKNVHAPILGYRAVKFVVIAVFVGFSFASIALSTRLQPGLEQKIVLPRDSYLQDYFDDLATYMKVGPPLYFVIKNFNYSSASEHTNKICSINQCDSNSLLNEIAKQSLSPETSYIAKPAASWLDDFLIWMSPEAFGCCRKFVNGSYCPPDDQPPCCQHDQDSSSCSASGACNNCTTCFLRSDLHNGRPSTTQFKEKLPWFLDALPSSDCSKGGKGAYSTSLDLNGYENGIIQASAFRTYHTPLNKQSDYVNSMKAARDFSSKMSKELQMQMFPYSVFYIFFEQYLGVWKTAIMNICVCLGTVFVVCFVVTSSLWASIIILIVLAMIVLDLMGMMAILGIQLNAISIVNLVMSIGIAVEFCVHITHAFMLFFSIVILKPLMTFFEMQIGIGNRESRARQALSTMGASVFSGITLTKLVGVIVLRFAKSEVFVVYYFQMYLALVIIGFLHGLIFLPCYIATSSHPSSPIQNGGSNLGLDSSHSTGFPKPLGTGSSCPGGVYRGIYITVPRGKAGNRAVAVTDVYLASKKIMFLSPCFPRGPDCKFGSFSYKSFFLNVVFRSNYAV

SEQ ID NO: 8178 - protein, 381 aa, Sorghum bicolor
MAPIFAAASHASLLPLSHVDRPAAGRLVRGTLRPHTSGLRLRRPPGATGRGRGRGRGGIPDEWGERSPPGAPEAPAQPDPLIDDEDDSADGNSRPIVVDEWGEPGAPEPEPPSAADPPSPAADDEWEEEPEASVPDPTPAPAAAEEDEQAVKREELKRCLVDTVYGSDLGFRASTEVRGEVVELVTQLEAANPTTAPVETSDLLDGNWILIYTAYSELLPILAAGATPLVKVKQISQEIDSKSMTIVNASTLTTPFASFSFSATASFEVQSPSRIEVQFKEGSFQPPVISSSVDLPQQIDIFGQKISLGPVQQALNPLQQAFASIAGSISGQPPLKVPIPGNNRARSWLLTTYLDKDLRISRGDGGLFILAKEGSPLLDLL

SEQ ID NO: 8179 - protein, 785 aa, Hordeum vulgare
MDAEAGAVAAAQELPWRQHYRNLLLLAYQSFGVVYGDLSTSPLYVYKSTFSGRLGQYQDEQTVYGVLSLIFWTFTLVPLLKYVIIVLSADDNGEGGPFALYSLLCRHAKLSLLPNQQAADEELSTYYRDGFAAQHGSSPWLRRFLEKHKTVKTGLLVVVLCAASMVIGDGVLTPAISVLSSMSGLQVRATGLQERSVVLLSCIVLVGLFSLQHRGTHKVAFMFAPIVIIWLLCIGGIGLYNIVHWNPKIYQAISPYYIVKFFRTTGTDGWIALGGILLSMTGSEAMFADLGHFTSASVRLAFITIIYPCLILQYMGQAAFLSKNMLHMRTSFYDSIPGPVFWPVFVVATLAAVVGSQAVISATFSIVKQCHALGCFPRVKIVHTSRWIYGQIYIPEINWILMVLCVAVTVAFGDTTLIGNAYGIACMTVMLITTFFMAFIIIFVWQKNIIFALLFLLFFGSIETVYLSSSLMKVHQGGWVPLVLAFIFMSVMFIWHYGTKRKYQFDLQNKVSMRSILSLGPNLGIVRVPGIGLIYTELVTGVPAIFTHFVTNLPAFHEVLVFLCVKSVPVPYVQPDERYLVGRIGPRAYRMYRCIVRYGYKDVQRDDENFENMLVMSIARFIMMEAEDVSSSASYDIANEGRMAVIRTTDDAGTPLGMRDLGGLAESISTTRSSKSESLRSLQSSYEQESPSANRRRRVRFELPNEDAMDQQVKDELLALVEAKHAGVAYIMGHSYIKARRSSNFLKKFAVDVGYSFLRKNCRGPSVSLHIPHISLIEVGMIYYV

SEQ ID NO: 8180 - protein, 784 aa, Triticum aestivum
MDAEAGAAAAQQLPWRQHYRNLLLLAYQSFGVVYGDLSTSPLYVYKSTFSGRLRQYQDEQTVYGVLSLIFWTFTLVPLLKYVIIVLSADDNGEGGPFALYSLLCRHAKLSLIPNQQAADEELSTYYRDGFAAQHESSPWLRRFLEKHKTVKTGLLVVVLCAASMVIGDGVLTPAISVLSSMSGLQVRATGLQERSVVLLSCIVLVGLFSLQHRGTQKVAFMFAPIVIIWLLCIGGIGLYNIVHWNPNIYQAISPYYIVKFFRTTGTDGWIALGGILLSMTGSEAMFADLGHFTSASVRLAFITIIYPCLILQYMGQAAFLSKNMFHTRTSFYDSIPGPVFWPVFVVATLAAVVGSQAVISATFSIVKQCHALGCFPRVKIVHTSRWIHGQIYIPEINWILMVLCVAVTVAFGDTTLIGNAYGIACMTVMLVTTFLMSFIVIFVWQKNIIFALLFLLFFGSIETVYLSSSLMKVRQGGWVPLVLAFIFMSVMFVWHYGTKKKYQFDLQNKVSMRSILSLGPNLGIVRVPGIGLIYTELVTGVPAIFTHFVTNLPAFHEVLVFLCVKSVPVPYVQPDERYLVGRIGPKAYRMYRCIVRYGYKDVQRDDENFENMLVMSIARFIMMEAEDVSSSASYDIANEGRMAVIRTTDDAGTPLGMRDLGGLAESISTTRSSKSESLRSLQSSYEQESPSAGRRRRVRFELPNEDAMDQQVKDELLALVEAKHAGVAYIMGHSYIKARRSSNFVKKFAIDVAYSFLRKNCRGPSVSLHIPHISLIEVGMIYYV

SEQ ID NO: 8181 - protein, 746 aa, Secale cereale
TSPLYVYKSTFSGRLRHYQDEQTVYGVLSLIFWTFTLVPLLKYVIIVLSADDNGEGGPFALYSLLCRHAKLSLLPNQQAADEELSTYYRDGFAAQHGSSPWLRRFLEKHKTVKTGLLVVVLCAASMVIGDGVLTPAISVLSSMSGLQVRATGLQERSVVLLSCIVLVGLFSLQHRGTQKVAFMFAPIVIIWLFCIGAIGLYNIVHWNPNIYQAISPYYIFKFFSTTGTDGWIALGGILLSMTGSEAMFADLGHFTSASVRLAFITIIYPCLILQYMGQAAFLSKNMFHTRTSFYDSIPGPVFWPVFVVATLAAVVGSQAVISATFSIVKQCHALGCFPRVKIVHTSRWIHGQIYIPEINWILMVLCVAVTVAFGDTTLIGNAYGIACMTVMLVTTFLMAFIIIFVWQKNIIVALLFLLFFGSIETVYLSSSLMKVHQGGWVPLVLAFIFMSVMFIWHYGTRKKYQFDLQNKVSMRSILSLGPNLGIVRVPGIGLIYTELVTGVPAIFTHFVTNLPAFHEVLVFLCVKSVPVPYVQPDERYLVGRIGPRPYRMYRCIVRYGYKDVQRDDENFENMLVMSIARFIMMEAEDVSSSASYDIANEGRMAVIRTTDDAGTPLGMRDLGGLAESISSTRSSKSESLRSLQSSYEQESPSAGRRRRVRFELPNEDAMDQQVKDELLALVEAKHAGVAYIMGHSYIKARRSSNFVKKFAIDVGYSFLRKNCRGPSVSLHIPHISLIEVGMIYYV

SEQ ID NO: 8182 - protein, 770 aa, Sorghum bicolor
MAPSSPSSAEPTRVSGRKRAAKAVEIHQSQEEEEEQKVVAASSAKRSRKAASSGKKPKPTPKQAKAGRKKKGEAERKEPVEDDVCAEEPDEEELAMGEAEAEAEAEADEQAMQEEVAAVAAGSPGKKRVGRRSAAAGGDHEPEFVGNAVPAVEARSNWPKRYERSTAATKPEEDEELKARCHYRSAKVDNVVYCLGDDVYVKAGENEADYIGRITEFFEGTDRCHYFTCHWFFRAEDTVINSLVSINVDGHMHDPRRVFLSEEKNDNVLDCIISKVKIVRVDPNIDPKAKAQLIEHCDLYYDMSYSVAYSTFANISSENGQSGSETASGISDGDVDLETSSSMPERTATLLDLYSGCGGMSTGLCLGAALSGLKLETRWAVDLNSFACQSLKYNHPQTEVRNEKADEFLALLKEWAVLCEKYVQDIDSNLAGSEDQEDEGSPLDKDEFVVEKLIGICYGGSGRKNGIYFKVQWEGYGPEEDTWEPIDNLSDCPLKIREFVQEGHRRKILPLPGDVDVICGGPPCQGISGFNRFRNRDEPLKDEKNKQMVTFMDIVAYLKPKYVLMENVVDILKFADGYLGKYALSCLVAMKYQARLGMMVAGCYGLPQFRMRVFLWGALSSMVLPKYPLPTYDVVVRGGAPNAFSQCIVAYDETEKPSLKKALLLGDAISDLPKVENHQPNDVMEYGGSPKTEFQRYIRLGRKDMLDWSFGEEAGPDEGKLLDHQPLRLNNDDYERVQQIPVKKGANFRDLKGVKVGANNIVSGIQKSSV

SEQ ID NO: 8183 - protein, 913 aa, Sorghum bicolor
MAPSSPSPAAPTRVSGRKRAAKAEEIQEEEVVVASSAKRSRKAPSSGKKPKPTPKQAKPAKAARKKKGEAERKEPVEDDVCAEEPDEEELAMGEEEAEAAADEQAMQEEVAAVVAGSPGKKRVGRRSAAAGGDHEPEFVGNAVPAAEARSNWPKRYERSTAAKKPEEDEELNAKCHYRSAKVDNVVYCLGDDVYVKAGENEADYIGRITEFFEGTDRCHYFTCRWFFRAEDTVINSLVSINVDGHKHDPRRVFLSEEKNDNVLDCIISKVKIVHVDPNMDPKAKAQLIEHCDLYYDMSYSVAYSTFANISSENGQSGSETASGISSDDVDLEAPSSMPERTATLLDLYSGCGGMSTGLCLGAALSGLKLETRWAVDLNSFACQSLKYNHPQTEVRNEKADEFLALLKEWAVLCEKYVHQDVDSNLAGSEDQEDEGSPLDKDEFVVEKLIGICYGGSGRKDGIYFKVQWEGYGPEEDTWEPIDNLSDCPLKIREFVQEGHRRRILPLPGDVDVICGGPPCQGISGFNRFRNRDEPLKDEKNKQMVTFMDIVAYLKPKYVLMENVVDILKFADGYLGKYALSCLVAMKYQARLGMMVAGCYGLPQFRMRVFLWGALSSMVLPKYPLPTYDVVVRGNTPNAFSQCMVAYDEKQKPHLKKALLLGDAISDLPKVENHQPKEVMEYGGSPKTEFQRYIRLSRKDMLDWSFGEEAGPDKGKLLDHQPLRLNNDDYERVQQIPVKKGANFRDLKGVKVGANNIVEWDPEIERVKLSSGKPLVPDYAMSFIKGKSLKPFGRLWWDETVPTVVTRAEPHNQIILHPTQARVLTIRENARLQGFPDYYRLFGPIKEKYIQVGNAVAVPVARALGYCLGQAYLGESEGSHPLYQLPPSFTALGRTAVQARASPVGTPVGEVVEQ

SEQ ID NO: 8184 - protein, 134 aa, Sorghum bicolor
MSFIKGKSPKPFGRLWWDETVPTVVTRAEPHNQAILHPTQARVLTVRENARLQGFPDYYRLFGPIKEKYIQVGNAVAVPVARALGYCLGQAYLGESEGSHPLYQLPPSFTALGQTAVQARASSVGTPAGEVVEQ

SEQ ID NO: 8185 - protein, 915 aa, Zea mays
MAPSSPSSARPTRASGRKRSAMAEEIHQNQEEEEEVVAASTAKRRRKAASSGKKPKPTPKQAKPAVAGMKKKGETEKTEPVVDDVCAEEPDEEELAMGEEEAEAEEQAMQEVVAAVAAGSPGKKRVGRRSAAASGDHVPEFIGSPVAAAEAHSNWPKRYERSTAANKPEEDDELKARCHYRSAKVDNIVYCLGDDVYVKAGENEADYIGRITEFFEGTDRCHYFTCRWFFRAEDTVINSLVSINVDGHKHDPRRVFLSEEKNDNVLDCIISKVKIVHVDPNMDPKAKAQLIEHCDLYYDMSYSVAYSTFANISSENGQSGSETASGISSDDAGLETSSNMPERTATLLDLYSGCGGMSTGLCLGAALSGLKLETRWAVDLNSFACQSLKYNHPQTEVRNEKADEFLALLKEWAVLCEKYVHQDVDSNLAGSEDQEDADTLDKDEFVVQKLIGIRYDGTGRKKGVYFKVQWEGYGPEEDTWEPIDNLSDCPLKIREFVQEGRKRKILPLPGDVDVICGGPPCQGISGFNRFRNRDEPLKDEKNKQMVTFMDIVAYLKPKYVLMENVVDILKFADGYLGKYALSCLVAMKYQARLGMMVAGCYGLPQFRMRVFLWGALSSMVLPKYPLPTYDVVVRGGAPNAFSQCMVAYDETQRPSLKKALLLGDAFSDLPKVENHQPNDVMEYGGSPKTEFQRYIRLGRKDMLDWSFGEEAGPDEGKLLDHQPLRLNNDDYERVKQIPVKKGANFRDLKGVKVGANNVVEWDPEVERVYLSSGKPLVPDYAMSFIKGKSLKPFGRLWWDETVPTVVTRAEPHNQVILHPTQARVLTIRENARLQGFPDYYRLFGPIKEKYIQVGNAVAVPVARALGYCLGQAYLGESDGSQPLYQLPASFTSVGRTAVQANAVSVGTPAGEVVEQ

SEQ ID NO: 8186 - protein, 1480 aa, Setaria italica
MAPSSPSSAAPTRASGRKRAAKAEEIHRNQEEEEEVAAASSAKRRRGASSGKKPKPPPKQAKTAKAGRKKKAEAERAEPVEDDVCAEEPDEEEMAMGEEEAAAEAEEQEAAAAAAGSPGKKRVAQPRKRGTAAAGDHEPEFVGEPVPAAEARANWPKRYDRSAAARRPEEDEEVKARCHYRSAKVDNIVYTLGDDVYVKAEENEADYIGRITEFFEGTDRCQYFTCRWFFRPEDTVINSLVCIDVDGKKHDPRRVFLSEEKNDNVLDCIISKVKIVHVDPNMDPKAKAQLIEHCDLYYDMSYSVAYSTFANIPSENGASGSETASGISSDDMDLETSSGAPVRTATLLDLYSGCGGMSTGLCLGAALAGLKLETRWAVDLNSYACQSLKYNHPQTEVRNEKADEFLALLKEWAVLCDKYVHKDVGSDSAGSEDQEDDGSPLDKDEFVVEKLIGICYGGSGRENGLYFKVQWAGYGPEEDTWEPIDNLSDCPLKIKEFVQEGYRRKILPLPGDVDVICGGPPCQGISGFNRFRNRNEPLKDEKNKQMVTFMDIVAYLKPKYVLMENVVDILKFADGYLGRYALSCLVAMNYQARLGMMVAGCYGLPQFRMRVFLWGALSSMVLPKYPLPTHDVVVRGGAPNAFSQSIVAYDETQRPSLKKALLLGDAISDLPQVENYQPHDVMEYTSSPKTEFQRYIRLGRKDMLDWSFGEEAGPDEGKLLDHQPLRLNNDDYERVKQIPVKKGANFRDLKGVKVGANNIVEWDPEIERVYLSSGKPLVPDYAMSFIKGRSPKPFGRLWWDETVPTVVTRAEPHNQIILHPTQARVLTVRENARLQGFPDYYRLFGPIKEKYIQVGNAVAVPVARALGYCLGQAFLGESEGSQPLYELPASFTSVARVAQVGASSVSTPAGEMASAPQSSPSSGNSTQSPPPSPSPPPPSPPPSQASISPPKVESSSFPAAKLSPPPPAPRKSGGSGNGGETSYSSSKDGKKKSSSSPSAPDHVGAVITGVVLGVVGFALLMAIVACLCCSRKKKKRPPPMNMPFYTDEKGNVYYPNAGLPPMWQQYGSNGSIPPPPGWHQHGGGNPLSQSPGSMAAPLSGEIYSSGPHGPALPPPSPNVALGFSKSSFSYEELAAATSGFSAGNMLGQGGFGYVHKGVLAGSGKEVAVKQLKSGSGQGEREFQAEVEIISRVHHRHLVSLVGYCIAGNQRMLVYEFVPNNTLEHHLYSKQGPVMDWPTRMKIALGSAKGLAYLHEDCHPRIIHRDIKASNILLDANFEAMVADFGLAKLTTDTNTHVSTRVMGTFGYLAPEYASSGKLTDRSDVFSFGVMLLELLTGRRPIDTANYMEDSLVDWARPLLAAALAGEAGFEELVDARLGGEYSAVEVERMAACAAASTRHSAKRRPKMSQIVRALEGDASLDDLHQDGVKPGQSMLFSAGGSENISRLRQLAFDSGEHDDYTTDYSTDSSAATTGRPPRRP

SEQ ID NO: 8187 - protein, 908 aa, Pennisetum glaucum
AVATRSSGRKRAAAKAEEIRRNQEEEAEEVPAASNAKRRRGASSSGKKPKPPTKQAKAGRKKKAEAESADPVEDDVCAEEPDEEEMAMGEEEAEAEAQEQEAATAAAAGSPGKKRVTQPRKRGAVAAGDHEPEFVGEPVPAAEARANWPKRYDRSTAARGPEDDEEVKARCHYRSAKVDNIVYTLGDDVYVKAEENKADYIGRITEFFEGTDHCQYFTCRWFFRPEDTVIDSLVCINVDGKKHDPKRVFLSEEKNDNVLDCIISKVKIVHVDPNMDLKAKAKLIEHCDLYYDMSYSVAYSTFANIPSENGASGSETASGISSDDMDLETSSGAPGRTATLLDLYSGCGGMSTGLCLGAALAGLKLETRWAVDLNSYACESLKYNHPKTEVRNEKADEFLALLKEWAVLCDKYVHKDVGSDSAGSVDQEDDGSPLDKDEFVVEKLIGICYGGSGRKDGIYFKVQWAGYGPEEDTWEPIDNLSDCPLKIKEFVQEGYKRKVLPLPGDVDVICGGPPCQGISGFNRFRNRNEPLKDEKNKQLVTFMDIVAYLKPKYVLMENVVDILKFADGYLGRYALSCLVAMNYQARLGMMVAGCYGLPQFRMRVFLWGALSSMVLPKYPLPTHDVVVRGGAPNAFSQSIVAYDETQRPVLKKALLLGDAMSDLPPVENHQPNDVMEYTSSPKTDFQRYIRLGRKDMLDWSFGEETGPDEGKLLDHQPLRLNNDDYERVKQIPFKKGANFRDLKGVKVGANNIVEWDPDVERVYLASGKPLVPDYAMSFIKGRSLKPFGRLWWDETVPTVVTRAEPHNQTILHPTQARVLTIRENARLQGFPDYYRLFGPIKEKYIQVGNAVAVPVARALGYCLGQAFLGESQGSEPLYELPASFTYVAGVAQAGASSVSTPAGEVVEQ

SEQ ID NO: 8188 - protein, 360 aa, Sorghum bicolor
MNMGGRTPAAATTTIRCKYCSACLTVCPGERAVQCTQCCGVTRIRRSLSSRIPLPPAMTRPAAPMGAFPCSRGKKRAVLIGISYASVRRGCGQLRGPINDVKCMRQLLCQRFAFPSDSIIMLTDEQKDPLRLPTKDNIRMAMRWLVQGCSSGDSLVFHFSGRGSQVADEDCDELDGYDEAICPLDSFDKGPILDDEINETIVRPLVYGAKLHAVVDACHSATVLDLPFLCNMSRTGNWQWEDHRPPSGVCKGTSGGQAVLISGYSDGKTKFSVTPEACATVGAMTHSFLKAVECEQQGVTYGRLLTSMKAFMTNAGGCNQLQGPICAGVPARKVANFSGVQEPNLSCSEMFDVYRKPFAL

SEQ ID NO: 8189 - protein, 838 aa, Sorghum bicolor
MEAALGALCRAGGWSYAAVWRFHPQDPRLLTLGDCYSEDEAKTMVQKMLNLVEIVGEGILGEALVSGECQWIYDDTCHVLNQTSHADNRDLYLDYTWWQHQFLNGIKTIAVLPLQLQGLVQFGSTRKVPRSSILLNQVRDIFDRMKNASSDGPMEYTHNSLAYGQQPILASLISANDMLVHNKVNPLQTEKPEENIEITESTRSSMCSPSNSQRSLNDLTSHGTGNTSTDTHILAMPVNSKTIYELKRFDNVTKLFHQSADDRVGFQVNPSKEPGSIIAGVMSGYKSSNNIHRTENDSCDQNTEYTPYLYTTTNSANSGLDELSYSGTGLSSSFTAVSGKVKNCLQTESDKFLCKSVSFSSNPCASKIQENRLSPYHALMHEQSLIPDDPGESVRLLSHEESFNVQGDSMQFEDGTRFTCQDNSTFPELPNRSPEEATAETLEKESSGNNSLLETMMLDLSTNSFVQDWWDDSVLLAENLPNSSEKHSEPAIELANRHSLPTGERGLPFIPVIEQLLGDVAHPPAGHSSLEVDATALAGRVSDYQLPQFAFRDCLTAHNAQVPSLACSNYTSRTGSAQNGSSEVPSANISVDDTCSFNTANSKGSQSSNPEGKVAKRRARAGESTRPRPKDRQLIQDRVKELREIVPNGAKCSIDALLERTIKHMLFLQSVNKYAEKIKQADEPKIIDKESGVVLKDNPDAGRNGGATWAYEVAGQTMVCPIIIEDLSPPGQMLVEMLCEERGLFLEIADNIRGFGLTILKGQMELRDGKIWSRFLVEANREVTRMDIFLSLVKLLEQNSLVRSTDQMAKVMNNGVPSFANHQRSPMPVPVGIAERLQ

SEQ ID NO: 8190 - protein, 806 aa, Oryza sativa
MAFGRGSKMDGRRSSPSSSLCTTTTVVVFVALCLVGAWMMTSSTIFPLEITSNKKAAVKEQPARVNYGASEEAAAASGNSAEGVDRFGDTDNNDNAVPEEPNNTVPSEEEKFSENTVEKPVESSEEKAPPKEKEESKDTFDDANGKTEQSSAKEDGDSESGSGQSDGSKNGDDEEKSEEKKDDEQSDGERKDDQEEKAEGSGSKDTTDQPQIEETVDESGEKGQGAKSNEVFPDGAQSELLKESNTENGSFKTQDAESKNEKESQAASNSSDDETTYNWKLCNNNAGTDYIPCLDNEKAIKKLRTTKHYEHRERHCPVEPPTCVVPLPEGYKRPVEWPTSRDKVWYSNVPHTKLAEYKGHQNWVKVSGDHLLFPGGGTQFKNGALHYIDTIQQALPDIAWGKRSRVILDVGCGVASFGGYMFERDVLTMSFAPKDEHEAQVQFALERGIPAISAVMGTKRLPYPSRVFDVIHCARCRVPWHIEGGMLLLELNRLLRPGGYFVWSATPVYQKLPEDVEIWNAMSSLTKAMCWKMVNKTKDKLNQVGMAIYQKPMDNSCYEKRPENSPPLCKETDDADAAWNVPLQACMHKLPAGQSVRGSKWPETWPQRLEKTPYWIDDSHVGIYGKPGNEDFEADYAHWKRVVSKSYVNGMGIDWSKVRNVMDMRAVYGGFAAALRDQKVWVMNIVPTDSADTLPIIYERGLFGMYHDWCESFSTYPRTYDLLHADHLFSKLKKRCKLLPVFAEVDRILRPEGKLIVRDNAETINELQGMVKSLQWEVRMTYTKGNEGLLCVQKSMWRPKEIEASM

SEQ ID NO: 8191 - protein, 812 aa, Brachypodium distachyon
MAFGRGAKMDGRRPSSPSSSLCTTTTVVVFVALCLVGAWMMTSSTVFPLEVSSSNKKSEPLDASSNKKPEVRDQRAAVDFGATEESPSGNAGGSSAKFEDTDNNDNVPDESHNNRDAPEEEKFTEDTMEKPVERTEEKEAPKEKDEVKDSFDDANGKSEVKNSKEGGETGRSGDEEGKDNETTTENDVDQFNGEKKEDQEGKSGDDAMQDATEQPQIEEKVEESGEKEQAAKANEVFPDAAQSELLKESNTENGSFSTQAAESKKEKEAQASSKSSGDGITYSWKLCNSSAVTDYIPCLDNEKAIKKLHSTKHYEHRERHCPDEPPTCLVPLPEGYKRPIEWPKSRDKVWYSNVPHTKLAEYKGHQNWVKVSGDHLLFPGGGTQFKNGALHYIDTIQQALPDIAWGKRSRVILDVGCGVASFGGYMFDRDVLTMSFAPKDEHEAQVQFALERGIPAISAVMGTKRLPYPSRVFDVIHCARCRVPWHIEGGKLLLELNRLLRPGGYFVWSATPVYQKLPEDVEIWNAMSSLTKSMCWKMVKKTKDTLNQVGMAIYQKPMDNNCYEKRSEDSPPLCKETDDADASWNITLQACIHKLPVGPSVRGSKWPEFWPQRLEKTPFWIDGSHVGVYGKPANEDFEADYAHWKRVVSKSYVNGMGIDWSKVRNVMDMRAVYGGFAAALRGQRQVWVMNIVPIDSPDTLPIIYERGLFGMYHDWCESFSTYPRTYDLLHADHLFSKLKKRCKLLGVFAEVDRILRPEGKLIVRDSAETIIELEGMAKSLHWEVTMTYAKGNEGLLCVQKTMWRPKEIEASM

SEQ ID NO: 8192 - protein, 165 aa, Saccharum officinarum
METAAVAASGAGRRIMVAVDEGEESLHALNWCLANVVSPAGGDTLLLVHARRPRPVYAAMDSAGYMMTSDVLASVERHANAVSAAAVDKAKRVCADHPHVKVETMVESGDPRDVICDAADKMAADLLVMGSHGYGFIQRAFLGSVSNHCAQNCKCPVLIVKRPKE

SEQ ID NO: 8193 - protein, 165 aa, Sorghum bicolor
METAAVAASAAGRRIMVAVDEGEESLHALNWCLANVVSPAGGDTLVLVHARRPRPVYAAMDSAGYMMTSDVLASVERHANAISAAAVDKAKRVCAGHPHVKVETMVESGDPRDVICDAADKMAADLLVMGSHGYGFIQRAFLGSVSNHCAQNCKCPVLIVKRPKE

SEQ ID NO: 8194 - protein, 155 aa, Setaria italica
AGRRIVVAVDEGEESVHALTWCLANVVSPAGGDTLVLVHARRSRPVYAAMDSAGYIMTSDVLASVERHATAVSAAAVDKAKRICAEHPHLAVETLVESGDPRDVICDATDKVGADLLVMGSHGYGFIQRAFLGSVSNHCAQNCKCPVLIVKRPKE

SEQ ID NO: 8195 - protein, 182 aa, Oryza sativa
MASSVPEDGASAAAAAATADPAAAAAEAPGRRIVVAVDESEESTHALTWCLANVVSSSGGDTLVLLHARRPRPVYAAMDSSGYMMTSDVMASMDKYAAAVSAAAVGKAKHICAAFPHVTVETMVESGDPRDVICDATEKMAADLLVMGTHGYGLIQRAFLGSVSNHCAQNCKCPVLIVKRPK

SEQ ID NO: 8196 - protein, 356 aa, Triticum aestivum
MAAESQTESGNCSAWAAKDPSGVLSPHSFNRRAVRHDDVSLRITHCGVCYADVIWTKNRHNDSVYPLVPGHEIAGVVTEVGSDVKGFKLGDHVAVGTYVNSCRDCDNCNSFLDNHCSKFVFTFNGVDTDGTVTKGGYSSHIVVHERYCYKIPDGYPLEKAAPLVCAGITVYSPMMRHNMNQPGKSLGVIGLGGLGHMAVKFGKAFGLKVTVLSTSESKRDEAISLLGADNFVVSSDKTQMESLKNSLDFIVDTASGDHPFDPYLTLLKVRGLMALVGFPGEIRVHPATLNLGARTLSGSVTGGTKDTQEMINFCAANKIYPDIEVIKIDYINEALERLVNRDVRYRFVIDIESSLK

SEQ ID NO: 8197 - protein, 269 aa, Avena sativa
MAAESESCNCDAWAAKDPSGVLSPYRFSRRTVQRDDVSLRITHCGVCYADVVWTRNKHNDSVYPLVPGHEIAGVVTEVGSDVKGFKAGDHVAVGTYVNSCRDCDNCNSFLENHCSKFVFTFNGVDTDGTVTKGGYSTHTVVHERYCYKIPDGYPLEKAAPLVCAGITVYTPMMRHNMNQPGKSLGVIGLGGLGHMAVKFAKAFGLKVTVFSTSESKRDEAISLLGADNFVLSSNEKQMGSLKNSLHFIVDTASGNHPFDPYLALLKLVA

SEQ ID NO: 8198 - protein, 354 aa, Triticum aestivum
MAAESESCNCSAWAANDPSGVLSPHSFNRRAVRHDDVSLRITHCGVCYADVQWTRNLHHDSVYPLVPGHEIAGVVTEVGSDVKGFKPGDHVAVGTYINSCRDCDNCNNLLENHCSNFVFTFNGVDTDGTVTKGGYSTHIVVHERYCYKIPDGYPLDKAAPLACAGITVYTPMIRHNMNQPGKSLGVIGLGGLGHMAVKFGKAFGLNVTVLSTSESKRDEAINLLGADNFVVSSDKNQMEFLKNSLDFIVDTASGDHPFDPYLALLKVRGTMALVGFPGEIRVHPATLNLGARTLSGSVVGGTKDTQEMINFCAANRIYPNVEVIKIDYINEALERLVNRDVKYRFVIDIESSFK

SEQ ID NO: 8199 - protein, 356 aa, Triticum aestivum
MAAESQTETGNCSAWAAKDPSGILSPHSFNRRTVRHDDVSLRITHCGVCYADVIWTKNRHNDSVYPLVPGHEIAGVVTEVGSDVKGFKLGDHVAVGTYVNSCRDCDNCNSFLENHCSKFVFTFNGVDTDGAVTKGGYSTHIVVHERYCYKIPDGYPLEKAAPLVCAGITVYTPMTRHNMNQPGKSLGVIGLGGLGHMAVKFGKAFGLKVTVLSTSESKRDEAISVLGADNFVVSSDKKQMESLKNSLDFIVDTASGDHPFDPYLALLKVGGVMALVGFPGEIRVHPATLNLGARTLSGSVTGGTKDTQEMMNFCAANKIYPEIEVIKIDYVNEALERLVNRDVRYRFVIDIEGSFK

SEQ ID NO: 8200 - protein, 354 aa, Leymus cinereus x Leymus triticoides
MAAESESGNCSAWAAKDPSGILSPHSFNRRTVRHDDVSLRITHCGVCYADVIWTKNRHNDSVYPLVPGHEIAGVVTEVGSDVKGFKLGDHVAVGTYVNSCRDCENCNSFLENHCSKFVFTFNGVDTDGTVTKGGYSTHIVVHERYCYKIPDGYPLEKAAPLVCAGITVYTPMTRHNMNQPGKSIGVIGLGGLGHMAVKFGKAFGLKVTVLSTSESKRDEAISLLGADNFVVSSDKKQMESLKSSLDFVVDTASGDHPFDLYLALLKVGGLMALVGFPGEIRVHPATLNLGARTLSGSVTGGTKDTQEMINFCAANKIYPDVEVIKIDYINEALERLVNRDVRYRFVIDIESSFK

SEQ ID NO: 8201 - protein, 356 aa, Triticum aestivum
MAAESQTESGNCSAWAAKDPSGVLSPHSFNRRTVRHDDVSLRITHCGVCYADVIWTKNRHNDSVYPLVPGHEIAGVVTEVGSDVKGFKLGDHVAVGTYVNSCRDCDNCNSFLENHCSKFVFTFNGVDTDGTVTKGGYSSHIVVHERYCYKIPDGYPLEKAAPLVCAGITVYTPMMRHNMKQPGKSLGVVGLGGLGHMAVKFGKAFGLKVTVLSTSESKRDEAISLLGADNFVVSSDIRQMESLKNSLDFIVDTASGDHPFDPYLALLKVGGIMALVGFPGEIRVHPATLNLGARTLSGSVTGGTKDTQEMINFCTANKIYPDIELIKIDYINEALERLVNRDVRYRFVIDIESSLK

SEQ ID NO: 8202 - protein, 356 aa, Secale cereale
MAAGSETESGNCSAWAAKDPSGTLSPHSFNRRTVRHDDVSLRITHCGVCYADVIWTKNRHNDSVYPLVPGHEIAGVVTEVGSDVKGFKLGDHVAVGTYVNSCRDCENCNSFLENHCSKFVFTFNGVDTDGTVTKGGYSSHIVVHERYCYKIPDGYPLEKAAPLVCAGITVYTPMMRHNMKQPGKSLGVVGLGGLGHMAVKFGKAFGLKVTVLSTSESKRDEAISLLGADNFVVSADKKQMESLKSSMDFIVDTASGDHPFDPYLVLLKVGGVMALVGFPGEIRVHPATLNLGARTLSGSVTGGTKDTQEMINFCAANKIYPDIELIKIDYINEALERLVNRDVRYRFVIDIESSLK

SEQ ID NO: 8203 - protein, 356 aa, Secale cereale
MAAESETKSGNCSAWAAKDPSGILSPHSFNRRTVRHDDVSLRITHCGVCYADVIWTKNRHNDSVYPLVPGHEIAGVVTEVGSDVKGFKLGDHVAVGTYVNSCRDCDNCNSFLENHCSKFVFTFNGVDTDGTVTKGGYSSHIVVHERYCYKIPDGYPMEKAAPLVCAGITVYTPMMRHNMKQPGKSLGVVGLGGLGHMAVKFGKAFGLKVTVLSTSESKRDEAISLLGADNFVVSSDKKQMESLKNSLDFIVDTASGDHPFDPYLALLKVRGLMALVGFPGEIRVHPATLNLGARTLSGSVTGGTKDTQEMINFCAANKIYPDIEVIKIDYINEALERLVNRDVRYRFVIDIESSLK

SEQ ID NO: 8204 - protein, 356 aa, Hordeum vulgare
MAAESGTESGNCSAWAAKDPSGLLSPHTFNRRTVRHDDVSLRITHCGVCYADVIWTKNRHNDSVYPLVPGHEIAGVVTEVGSDVKGFKLGDHVAVGTYVNSCRDCDNCNSFLENHCSKFVFTFNGVDTDGTVTKGGYSSHIVVHERYCYKIPDGYPLEKAAPLVCAGITVYTPMTRHNMNQPGKSLGVVGLGGLGHMAVKFGKAFGLKVTVLSTSESKRDEAINLLGADNFVVSSDKKQMESLKSSLDFIVDTASGDHPFDPYLALLKVGGLMALVGFPGEIRVHPATLNLGARTLSGSVTGGTKDTQEMINFCAANKIYPDIELIKIDYINQALERLVNRDVRYRFVIDIESSLK

SEQ ID NO: 8205 - protein, 333 aa, Secale cereale
GNCSAWAAKDPSGILSPHSFNRRTVRHDDVSLRITHCGVCYADVIWTKNRHNDSVYPLVPGHEIAGVVTEVGSDVKGFKLGDHVAVGTYVNSCRDCDNCNSFLENHCSKFVFTFNGVDTDGTVTKGGYSSHIVVHERYCYKIPDGYPLEKAAPLVCAGITVYTPMMRHNMKQPGKSLGVVGLGGLGHMAVKFGKAFGLKVTVLSTSESKRDEAISLLGADNFVVSSDKKQMESLKSSLDFIVDTASGDHPFDPYLALLKVGGVMALVGFPGEIRVHPATLNLGARTLSGSVTGGTKDTQEMINFCAENKIYPDIELIKIDYINEALERLVTGM

SEQ ID NO: 8206 - protein, 271 aa, Zea mays
MRRLSRAVAFLLLLLPLALAATTTMAAAVVAKAPAAAAAPPNVTAEMAKGGCKAFADLIAASPDASSTYQSAVEGGMTAFCPSDDAVRAFLPKYRNLSADGKAELLLFHAVPVHYSLGSLKSNNGPMNTLATDGAARSFNFTVQSQGDAVTIRTAAAAAPARVESTVLDKDPLAIYVIDAVVEPVELFKPAPSPSPTPAPAPAADAPKAGNGKAAARQRHPAPAVADAPGPAAEDDAAPVDQKDVKKSAADGAPCSRWWLAAALAAASALV

SEQ ID NO: 8207 - protein, 280 aa, Sorghum bicolor
MRRLSRAAALPLLLLLALAAATTTTTVAAAAAAKAKAPAAAAPPAPPNVTAEMAKGGCKAFADLIAASPDASSTYQSAVEGGLTVFCPSDDAVRAFLPKYKNLSADGKAELLLFHAVPVHYSLGSLKSNNGPMNTLATDGAARNFNFTVQNQGDVVTIRTAAGSGAPARVKSTAVDKDPLAVYVINAVVEPVELFKPAPSPTPAPAPAPAAAADAPKAGKKGAARHAPPAVADAPGPNADDNAAPVDQKDANKKSAAAGAPCDRWWLATVLAAAVASALA

SEQ ID NO: 8208 - protein, 487 aa, Pennisetum glaucum
MVGSVGNGLADLGASMNGASMNGVGKVAAADPLPMEIEPPADVMAAAAAAEAEGPAANGRKEIVMGRNVHTSCFAVKEPDADDEVTGEREATMASVLALYRRSLVERTKHHLGYPYNLDFDYGALGQLQHFSINNLGDPFIESNYGVHSRQFEVGVLDWFARLWELEKDEYWGDTTNCCTEGNLHGILVGREVFPDGILYASRESHYSVFKAARMYRMDCVKVDTLMSGEIDCADFQRKILQNRDKPAIINVNIGTTVKGAVDDLDLVIKTLEESGFKDRFYIHCDGALFGLMIPFVKKAPKVTFKKPIGSVSVSGHKFVGCPMPCGVQITRLEHINVLSSNVEYLASRDATIMGSRNGHAPIFLWYTLNRKGYRGFQKEVQKCLRNAHYLKDRLKESGIGAMLNELSSTVVFERPKDEEFVRRWQLACEGNIAHVVVMPSVNIDKLDYFLNELVEKRATWYQDGTSKPPCLARDLGVENCLCGLHK

SEQ ID NO: 8209 - protein, 469 aa, Brachypodium distachyon
MAGSVSNGLAELGKRGLPEEAAAAAAEPLPEELEPEVAEGIREIVMGRNVHASCFAVKEPDADDEVTGEREATMAGVLARYRRCLIERTKHHLGYPYNLDFDYGALAQLQHFSINNLGDPFIESNYGVHSRQFEVGVLDWFARLWDLEKDEYWGYITNCGTEGNLHGILVGREVFPDGVLYASRESHYSVFKAARMYRMDCVKVETLVSGEIDCTDFGRKLFENKDKPAIINVNIGTTVKGAVDDLDLVIETLEKTGFQNRFYIHCDGALFGLMMPFVKLAPKVSFKKPIGSVSVSGHKFVGCPMPCGVQITRLKHINALASNVEYLASRDATIMGSRNGHAPIFLWYTLNRKGYRGFQKEVQKCLRNAHYLKDRLRNAGISAMLNELSSTVVFERPKDEEFVRRWQLACEGNISHVVVMPSVTINKLDSFLNELVEKRVTWYQEGICQSPCIAGDVGQHNCLCTMHKV

SEQ ID NO: 8210 - protein, 466 aa, Hordeum vulgare
MKGGIANGVTAPSGPGLPEKAVAAPLPEELAPEVVEGAREIVLGRNMHASCFAVKEPDADDEFTGEREATMAGVLARYRRSLVERTKHHLGYPYNLDFEYGALSQLQHFSINNLGDPFIESNYGVHSRQFEVGVLDWFARLWDLEKDEYWGYITNCGTEGNLHGILVGREVFPDGILYASRDSHYSVFKAARMYRMDCVKVDTLVSGEMDCADFGRKLLENKDKPAIINVNIGTTVKGAVDDLDLVIETLEKSGFKDRFYIHCDGALFGLMMPFVKLAPRVSFKKPIGSVSVSGHKFVGCPMPCGVQITRLNHINALSSNVEYLASRDATIMGSRNGHAPIFLWYTLNRKGYRGFQKEVQKCLRNAHYLKDRLKDAGISAMLNELSSTVVFERPKDEEFVRRWQLACEGSISHVVVMPSVTVDKLDTFLNELVEKRVTWYQEGKCQSPCIAADVGQENCLCTLHKK

SEQ ID NO: 8211 - protein, 1099 aa, Triticum aestivum
MAEILDPAAAAAAGEPAEEQEEARPLSAAAAAAAADDDEDEEEEGDVCRICRNRGDDEHPLRYPCACSGSIKFVHQDCLLQWLDHSNSRQCEVCKHAFSFSPVYAQNAPTRLPFQELVFGVGMKTCHVFQFVLRLAFVLSVWLMIIPFITYWIWRLTFVRSLGEAQRLFLSHISAQLILSDCLHGFLLSAIIVLIFLGATSLRDYIRHLRELGGHEADRDDAGRERHGARAVRRLAGPNNRVPGADGNIDDLAEAQGLGAGELLRRNAENVAARLERLEAQVEQMLDGLDDADGAEDVPFDELVGMQGPVFHLVENAITVLASNAIFLIVVIFVPFSLGRIVLYYLSWFFSSASSPMLARVMPFTESAISLANETLNSAFNAMKNFSSDSHNEGVIGHVIEVVTQSLKINATGLAVMQGTGKSSLVKGTVIGSSYLSDLTTLAVGYMFIFCLVFLYIGSLALLRYARGERFTIGRLYGIAAILEAIPSLCRQFFSGMKHLMTMVKVAFLLVIELGVFPLMCGWWLDVCTLKMLGTTIAQRVEFFTMSPLASSSIHWLVGIVYMLQISIFVSLLRGVLRNGVLYFLRDPADPNYNPFRDLIDDPVHKHARRVLLSVAVYGSLIVMLVFLPVKLAMRVAPKTFPLDITIFDPFTEIPVDVLLFQICIPFAIEHFKPRATIKALLHHWFAVIGWALGLTDFLLPKPEENAAGQENWNGRAERRDRVHGGMEMVAPQLEQRMIQHAAIDNDGRGNANEANDVAEESDVDDQGDSEYSFALRIILLLILAWMTLLIFNAGMIVIPISLGRLVFEAVPRLPITHGIKCNDLFSFSIGCYIIWSAAAGTRYAVDYIRSRRLGFLVQQICKWCSIVLKSSALLSIWIFVIPVLIGLLFELLVIVPMRVPIDESPVFLLYQDWALGLIFLKIWTRLVMLDQMAPLVDESWRMKFERVREDGFSRLKGLWVLHEIITPIITKLLTALCVPYVLARGVFPVLGYPLIVNSAVYRFAWLGCLIFSTLFFCGKRFHVWFTNLHNSIRDDRYLIGRRLHNFGEDSRRSNEPDETPGSLEDDLALIPIDHQDNDDVGLRFRGNNRHEDAGVVVG

SEQ ID NO: 8212 - protein, 315 aa, Pennisetum glaucum
MSFLFKSSNSGTTEKGLSLEEQQDKINELRKELGEYSSAAIHDFLSDASLSRFLRARNWNVQKASKMMKAAVKWRLAFKPENIFWDDIAQEAETGKIYRADYKDKHGRTVLVLRPGLENTTSATGQIKYLVYSLEKAIMNLTEDQEKMVWLTDFQCWTLGSTPLKVTRETVNVLQDCYPERLGLAILYNPPRIFESFWKIVKPFLDHETRKKVKFVYSDDKESQKIMAEVFDIEELDSAFGGKNPATFEYNSYAERMQEDDKKMGSLHSSTDSLLESAGKDTNGADSDASSEASFYSGTDSPKHEVGEHGAPKNG

SEQ ID NO: 8213 - protein, 318 aa, Setaria italica
MSFLFKSSNGGTTEKGLSLEEQQEKVNELRKELGESSSAAIQDFLSDASLSRFLRARNWNVQKASKMMKAAVKWRLAFKPENIFWEDIAQEAETGKIYRADYKDKHGRTVLVLRPGLENTTSATGQIKYLVYSLEKAIMNLTEDQEKMVWLTDFQCWTLGSTPLKVTRETVNVLQECYPERLGLAILYNPPRIFESFWKIVKPFLDHETRKKVKFVYSNDTESQKIMAEVFDIEELDSAFGGKNPATFEYNSYAERMQEDDKKMGSLHSSTDSLLESAGKDTHGAASDASSEASFYSGTDSPKHEDGEHGAPTRHTII

SEQ ID NO: 8214 - protein, 318 aa, Setaria italica
MSFLFKSSNGGTTEKGLSLEEQQEKVNELRKELGESSSAAIQDFLSDASLSRFLRARNWNVQKASKMMKAAVKWRLAFKPENIFWEDIAQEAETGKIYRADYKDKHGRTVLVLRPGLENTTSATGQIKYLVYSLEKAIMNLTEDQEKMVWLTDFQCWTLGSTPLKVTRETVNVLQECYPERLGLAILYNPPRIFESFWKIVKPFLDHETRKKVKFVYSNDTESQKIMAEVFDIEELDSAFGGKNPATFEYNSYAERMQEDDKKMGSLHSSTDSLLESAGKDTHGADSDASSEASFYSGTDSPKHEDGELGAPTRHTII

SEQ ID NO: 8215 - protein, 318 aa, Oryza sativa
MSFLFKSSNGATTEKNLTLEEQQEKINDLRKELGEHSSEEIQDFLSDASCLRFLRARNWNVQKASKMMKSAVKWRVSYMPQKINWDDVAHEAETGKIYRADYKDKHGRTVLVLRPGLENTTSGKGQIKYLVYCLEKAIMSLTEDQEKMVWLTDFQSWTLGSTPLKVTRETVNVLQDCYPERLGLAILYNPPRIFESFWKIVKPFLDHETYKKVKFVYSSDKESQKIMADVFDLDKLDSAFGGRNPATFEYNSYAERMRADDIKMGSSFKSNGITLPQDHSHVSADKEANGGGSDASSEASFYSGTDSPNHEEGGSILA

SEQ ID NO: 8216 - protein, 291 aa, Sorghum bicolor
MSSMELLHAVIPEKQSEELMAPAAATTTTTTSSSATAMSGDEVAHVPQGWAKKKRSRRQRSEEENLALCLLMLSRGGNHRVQAAPPLVPSAAPVAAEFRCSVCGKSFSSYQALGGHKTSHRVKLPTPPAPPAAAVPAAVPLVEVEAPAPLTVIPPPPVEVVVREPATSSTAASSDGAAASSRVHRCSICHKEFPTGQALGGHKRKHYDGGVGGSSAASTDVLAATAPAATAETSEVGSSGNGSSAARAFDLNLPAVPEFVFRCGKAGKMWEEDEEVQSPLAFKKPRLLMTA

SEQ ID NO: 8217 - protein, 272 aa, Sorghum bicolor
MAPAAATTTTTTSSSATAMSGDEVAHVPQGWAKKKRSRRQRSEEENLALCLLMLSRGGNHRVQAAPPLVPSAAPVAAEFRCSVCGKSFSSYQALGGHKTSHRVKLPTPPAPPAAAVPAAVPLVEVEAPAPLTVIPPPPVEVVVREPATSSTAASSDGAAASSRVHRCSICHKEFPTGQALGGHKRKHYDGGVGGSSAASTDVLAATAPAATAETSEVGSSGNGSSAARAFDLNLPAVPEFVFRCGKAGKMWEEDEEVQSPLAFKKPRLLMTA

SEQ ID NO: 8218 - protein, 526 aa, Zea mays
MSLRPSERVEVRRNRYKVAVDAEEGRRRREDNMVEIRKSRREESLLKRRREGLQAQVPAPPSGVEKKLESLPAMVSGVYSDDNNLQLEATTQFRKLLSIERSPPIEEVIKSGVVPRFVQLLTREDLPQLQFEAAWALTNIASGTSENTKVVIDHGAVPIFVKLLGSGSDDVREQAVWALGNVAGDSPKCRDLVLANGALMPLLAQLNEHAKLSMLRNATWTLSNFCRGKPQPSFDQTKPALPALARLIHSNDEEVLTDACWALSYLSDGTNDKIQAVIEAGVCPRLVELLLHPSPSVLIPALRTVGNIVTGDDQQTQCIIDHQALPRLLNLLTQNHKKSIKKEACWTISNITAGNKDQIQAVISAGIIAPLLQLLQGAEFDIKKEAAWAISNATSGGSHEQIKYLVSEGCIVPLCDLLVCPDPRIVTVCLEGLENILKVGEHDKTMGATGDINVFAQMIDDAEGLEKIENLQSHDNNEIYEKAVKLLETYWMEEEDDAMATAGEAAPAVFDFSQGGNPPGGGLNLN

SEQ ID NO: 8219 - protein, 527 aa, Panicum virgatum
MSLRPSERVEVRRNRYKVAVDAEEGRRRREDNMVELRKNRREESLLKKRREGLQAQVPVPASGVEKKLESLPAMVSGVYSDDNNLQLEATTQFRKLLSIERSPPIEEVIQSGVVPRFVQFLTREDFPQLQFEAAWALTNIASGTSENTKVVIDHGAVPIFVKLLQSASDDVREQAVWALGNVAGDSPKCRDLVLANGALMPLLAQLNEHAKLSMLRNATWTLSNFCRGKPQPSFDQTKPALPALARLIHSNDEEVLTDACWALSYLSDGTNDKIQAVIEAGVCPRLVELLLHPSPSVLIPALRTVGNIVTGDDLQTQCIIDHQALPCLLNLLTQNHKKSIKKEACWTISNITAGNKDQIQAVISGGIIAPLLHLLQTAEFDIKKEAAWAISNATSGGSHEQIKYLVSEGCIKPLCDLLVCPDPRIVTVCLEGLENILKVGEHDKAAGATGDINVFAQMIDEAEGLEKIENLQSHDNNEIYEKAVKLLEAYWMEEEDEAMATAGEAAPAVFDFGQGGNPPAAGGLNFN

SEQ ID NO: 8220 - protein, 528 aa, Sorghum bicolor
MSLRPSERVEVRRNRYKVAVDAEEGRRRREDNMVEIRKNRREESLLKRRREGLQAQFPAPPSGVEKKLESLPAMVSGVYSDDNNLQLDATTQFRKLLSIERSPPIEEVIKSGVVPRFVQFLTREDFPQLQFEAAWALTNIASGTSENTKVVIDHGAVPIFVKLLGSASDDVREQAVWALGNVAGDSPKCRDLVLANGALMPLLAQLNEHAKLSMLRNATWTLSNFCRGKPQPSFDQTKPALPALARLIHSNDEEVLTDACWALSYLSDGTNDKIQAVIEAGVCPRLVELLLHPSPSVLIPALRTVGNIVTGDDMQTQCIIDHQALPRLLNLLTQNHKKSIKKEACWTISNITAGNKDQIQAVISAGIIAPLLQLLQTAEFDIKKEAAWAISNATSGGSHEQIKYLVAEGCIKPLCDLLVCPDPRIVTVCLEGLENILKVGEYDKNMGGATADGNLFAQMIDEAEGLEKIENLQSHDINEIYEKAVKLLEAYWMEEEDDTMATAAEAGPTVFDFSQGGNPPAGGGLNFN

SEQ ID NO: 8221 - protein, 523 aa, Setaria italica
MSLRPSERVEVRRNRYKVAVDAEEGRRRREDNMVEIRKNRREESLLKKRREGLQAQVPVPASGVEKKLESLPAMVSGVYSDDNNIQLEATTQFRKLLSIERSPPIEEVIQSGVVPRFVQSLTREDFPQLQFEAAWALTNIASGTSENTKVVIDHGAVPIFVQLLQSASDDVREQAVWALGNVAGDSPKCRDLVLANGALMPLLAQLNEHAKLSMLRNATWTLSNFCRGKPQPSFDQTKPALPALARLIHSNDEEVLTDACWALSYLSDGTNDKIQAVIEAGVCPRLVELLLHPSPSVLIPALRTVGNIVTGDDLQTQCIIDHQALPCLLNLLTQNHKKSIKKEACWTISNITAGNKDQIQAVINAGIIAPLLQLLQTAEFDIKKEAAWAISNATSGGSHEQIKYLVSEGCIKPLCDLLVCPDPRIVTVCLEGLENILKVGEHDKTAGATGDINVFAQMIDEHEGLEKIENLQSHDNNEIYEKAVKLLEAYWMEEEDDAMATVGEAAPAVFDFGQGGNPPAGFN

SEQ ID NO: 8222 - protein, 523 aa, Pennisetum glaucum
MSLRPSERVEVRRNRYKVAVDAEEGRRRREDNLVEIRKNRREESLLKKRREGLQAQAPVPASGVEKKLESLPAMVSGVYSDDNNTQLEATTQFRKLLSIERSPPIEEVIQSGVVPRFVQSLTREDFPQLQFEAAWALTNIASGTSENTKVVIDHGAVPIFVQLLQSASDDVREQAVWALGNVAGDSPKCRDLVLANGALMPLLAQLNEHAKLSMLRNATWTLSNFCRGKPQPSFDQTKPALPALARLIHSNDEEVLTDACWALSYLSDGTNDKIQAVIEAGVCPRLVELLLHPSPSVLIPALRTVGNIVTGDDLQTQCIIDHQALPCLLNLLTQNHKKSIKKEACWTISNITAGNKDQIQAVINGGIIPPLLQLLQTAEFDIKKEAAWAISNATSGGSHDQIKYLVTEGCIKPLCDLLVCPDPRIVTVCLEGLENILKVGEHDKAAGATGDANVFAQMIDEHEGLEKIENLQSHDNNEIYEKAVKLLETYWMEEEDDAMATAGEAAPAVFDFAQGGNPPAGFN

SEQ ID NO: 8223 - protein, 524 aa, Hordeum vulgare
MSVRPSERADARRNRYKVTVDADEGRRRREDNMVEIRKNRREESLLKKRREGLQAQAPIPAAGVEKKLESLPAMVGGVYSEDNNLQLEATTQFRKLLSIERSPPIEEVIQSGVVPRFVQFLTREDFPQLQFEAAWALTNIASGTSENTKVVIDHGAVPIFVKLLASGSDDVREQAVWALGNVAGDSPKCRDLVLANGALMPLLAQLNEHAKLSMLRNATWTLSNFCRGKPQPAFDQTKPALPALARLIHSNDEEVLTDACWALSYLSDGTNDKIQSVIDAGVCPRLVELLLHPSPSVLIPALRTVGNIVTGDDSQTQCIIDHQALGCLLSLLTENHKKSIKKEACWTVSNITAGNKDQIQAVITAGIIFPLVHLLQTAEFDIKKEAAWAISNATSGGSHDQIKYLVSEGCIKPLCDLLLCPDPRIVTVCLEGLENILKVGETDKNLGASGEGNVYAQMIDEAEGLEKIENLQSHDNNEIYEKAVKILEAYWMEEEDDAMGTTMEAPTGVAFDFGQGGNPDLNLG

SEQ ID NO: 8224 - protein, 524 aa, Triticum aestivum
MSVRPSERADARRNRYKVTVDADEGRRRREDNMVEIRKNRREESLLKKRREGLQAQAPIPAAGVEKKLESLPAMVGGVYSEDNNLQLEATTQFRKLLSIERSPPIEEVIQSGVVPRFVQFLTREDFPQLQFEAAWALTNIASGTSENTKVVIDHGAVPIFVKLLASGSDDVREQAVWALGNVAGDSPKCRDLVLANGALMPLLAQLNEHAKLSMLRNATWTLSNFCRGKPQPAFDQTKPALPALARLIHSNDEEVLTDACWALSYLSDGTNDKIQSVIDAGVCPRLVELLLHPSPSVLIPALRTVGNIVTGDDSQTQCIIDHQALGCLLSLLTQNHKKSIKKEACWTVSNITAGNKDQIQAVITAGIIGPLVHLLQTAEFDIKKEAAWAISNATSGGSHDQIKYLVSEGCIKPLCDLLLCPDPRIVTVCLEGLENILKVGETDKNLGASGEGNVYAQMIDEAEGLEKIENLQSHDNNEIYEKAVKILEAYWMEEEDDAMGATMEAPTGVAFDFGQGGNPDLNLG

SEQ ID NO: 8225 - protein, 524 aa, Secale cereale
MSVRPSERADARRNRYKVTVDADEGRRRREDNMVEIRKNRREESLLKKRREGLQAQAPIPAAGVEKKLESLPAMVGGVYSEDNNLQLEATTQFRKILSIERSPPIEEVIQSGVVPRFVQFLTREDFPQLQFEAAWALTNIASGTSENTKVVIDHGAVPIFVKLLASGSDDVREQAVWALGNVAGDSPKCRDLVLANGALMPLLAQLNEHAKLSMLRNATWTLSNFCRGKPQPAFDQTKPALPALARLIHSNDEEVLTDACWALSYLSDGTNDKIQSVIDAGVCPRLVELLLHPSPSVLIPALRTVGNIVTGDDSQTQCIIDHQALGCLLSLLTQNHKKSIKKEACWTVSNITAGNKDQIQAVITAGIIGPLVHLLQTAEFDIKKEAAWAISNATSGGSHDQIKYLVSEGCIKPLCDLLLCPDPRIVTVCLEGLENILKVGETDKNLGASGEGNVYAQMIDEAEGLEKIENLQSHDNNEIYEKAVKILEAYWMEEEDDAMGATMEAPTGVAFDFGQGGNPDLNLG

SEQ ID NO: 8226 - protein, 519 aa, Avena sativa
MSVRPNDRIDARRNRYKVTVDADEGRRRREDNMVEIRKNRREESLLKKRREGLQAQAPIPAAGVEKKLESLPAMVAGVYSEDNNMQLEATTQFRKLLSIERSPPIEEVIQSGVVPRFVQFLTREDFPQLQFEAAWALTNIASGTSDNTKVVIDHGAVPIFVKLLASGSDDVREQAVWALGNVAGDSPKCRDLVLANGALMPLLAQLNEHAKLSMLRNATWTLSNFCRGKPQPAFEQTKPALPALARLIHSNDEEVLTDACWALSYLSDGTNDKIQSVIDAGVCPRLVELLLHPSPSVLIPALRTVGNIVTGDDSQTQCIIDHQALSCLLSLLTQNHKKSIKKEACWTVSNITAGNKDQIQAVVNAGIIGPLVHLLQTAEFDIKKEAAWAISNATSGGSHDQIKYLVTEGCIKPLCDLLLCPDPRIVTVCLEGLENILKVGETDKNLGASGDGNVYAQMIDEAEGLEKIENLQSHDNNEIYEKAVKILEAYWMEEEDDAMGAGMEAPQGVSFDFGQGGQP

SEQ ID NO: 8227 - protein, 522 aa, Brachypodium distachyon
MSLRPNERVEARKSSYKSTVDADDGRRRREGDMVEIRKSRREESLLKKRREGLQAQAPVPAAGVEKKLESLPAMVAGVYSDDINLQLEATTQFRKLLSIERSPPIEEVIKSGVVPRFVQCLGRDDFPQLQFEAAWALTNIASGTSENTKVVIDHGAVPIFVKLLGSGSDDVREQAVWALGNVAGDSPRCRDLVLESGALMPLLAQLNEHAKLSMLRNATWTLSNFCRGKPQPAFDQTKPALPALARLIHSNDEEVLTDACWALSYLSDGTNDKIQSVIDAGVCPRLVELLLHPSPSVLIPALRTVGNIVTGDDSQTQCIIDHQALACLLSLLTQNHKKSIKKEACWTVSNITAGNKDQIQAVINAGIIGPLVHLLQTAEFDIKKEAAWAISNATSGGSHDQIKYLVSEGCIKPLCDLLICPDSRIVTVCLEGLENILKVGETDKNLGGDGNVYALMIDEAEGLEKIENLQSHDNNEIYEKAVKILEAYWMDEEDDAMGGAMEASQGVSFDFGQGGNPDLNLG

SEQ ID NO: 8228 - protein, 524 aa, Festuca arundinacea
  misc_feature (20)..(20): Xaa can be any naturally occurring amino acid
MSVRPNDRISARRNTYKVTXDADEGRRRREDNMVEIRKGRREESLLKKRREGLQAQVPIPAAGVEKKLESLPAMVAGVYSDENNMQLEATTQFRKLLSIERSPPIEEVIQSGVVPRFVQFLTREDFPQLQFEAAWALTNIASGTSDNTKVVIDHGAVPIFVKLLAAGSDDVREQAVWALGNVAGDSPKCRDLVLANGALMPLLAQLNEHAKLSMLRNATWTLSNFCRGKPQPAFEQTKPALPALARLIHSNDEEVLTDACWALSYLSDGTNDKIQSVIDAGVCPRLVELLLHPSPSVLIPALRTVGNIVTGDDSQTQCIIDHQALSCLLSLLTQNHKKSIKKEACWTVSNITAGNKDQIQAVVNAGIIGPLVHLLQTAEFDIKKEAAWAISNATSGGSHDQIRYLVSEGCIKPLCDLLLCPDPRIVTVCLEGLENILKVGETDKNLGGSGDGNVYAQMIDEAEGLEKIENLQSHDNNEIYEKAVKILEAYWMEEDDDAMGGAMEVPQGASFNFGQGGNPDLNLG

SEQ ID NO: 8229 - protein, 530 aa, Manihot esculenta
MSLRPSARTEVRRNRYKVAVDAEEGRRRREDNMVEIRKNRREESLQKKRREGLQAQPMPASIHSSAVEKKLEHLPSMVAGVWSDDSNLQLEATTQFRKLLSIERSPPIEEVIQAGVVPRFVEFLMREDFPQLQFEAAWALTNIASGTSENTRVVIDHGAVPIFVKLLGSPSDDVREQAVWALGNVAGDSPKCRDLVLGHGALIPLLAQLNEHAKLSMLRNATWTLSNFCRGKPQPPFDQVKPALPALARLIHSNDEEVLTDACWALSYLSDGTNDKIQAVIEAGVCPRLVELLLHPSPSVLIPALRTVGNIVTGDDMQTQCIINHQALPCLLNLLTNNYKKSIKKEACWTISNITAGNKEQIQAVIEANIIGPLVHLLQNAEFDIKKEAAWAISNATSGGSHEQIKYLVSQGCIKPLCDLLICPDPRIVTVCLEGLENILKVGEADKNLGNTGGVNQYAQMIDDAEGLEKIENLQSHDNTEIYEKAVKMLETYWLEEEDETMPPGDASQSGFQFGGGEMPAVPSGGFNFS

SEQ ID NO: 8230 - protein, 531 aa, Eucalyptus grandis
MSLRPNARTEVRRNRYKVAVDAEEGRRRREDNMVEIRKNRREESLQKKRREGLQAQQQTAPSLHSSAVEKKLEHLPSMIGGVYSDDNNLQLEATTQFRKLLSIERSPPIEEVIQSGVVPRFVEFLMREDFPQLQFEAAWALTNIASGTSENTKVVVDHGAVPIFVKLLASPSDDVREQAVWALGNVAGDSPKCRDLVLANGALLPLLAQLNEHAKLSMLRNATWTLSNFCRGKPQPPFDQVRPALPALERLIHSNDEEVLTDACWALSYLSDGTNDKIQAVIEAGVCPRLVELLLHPSPSVLIPALRTVGNIVTGDDLQTQCIINHQALPCLLNLLTGNYKKSIKKEACWTISNITAGNKEQIQAVIEANIIAPLVHLLQNAEFDIKKEAAWAISNATSGGSHEQIKFLVCQGCIKPLCDLLICPDPRIVTVCLEGLENILKVGEAEKNLGGTGDVNLYAQMIDDAEGLEKIENLQSHDNNEIYEKAVKLLETYWLEEEDEAMPPEDSAHPGVPFGGNELPPVPSGGFKFG

SEQ ID NO: 8231 - protein, 531 aa, Elaeis guineensis
MSLRPSERAEVRRNRYKVAVDAEEGRRRREDNMVEIRKSRREESLQKKRREGMQAQPFPPPSMHASALEKKLESLPAMVAGVYSDDSTLQLEATTQFRKLLSIERSPPIEEVIQSGVVPRFVEFLTREDFPQLQFEAAWALTNIASGTSENTKVVIDHGAVPIFVKLLSSPSDDVREQAVWALGNVAGDSPRCRDLVLANGALIPLLAQLNEHAKLSMLRNATWTLSNFCRGKPQPVFEQVKPALPALERLIHSNDEEVLTDACWALSYLSDGTNDKIQAVIEAGVIPRLVELLMHPSPSVLIPALRTVGNIVTGDDVQTQYVINYQALPCLLSLLTHNHKKSIKKEACWTISNITAGNKDQIQAVIAAGIIGPLVHLLQTAEFDIKKEAAWAISNATSGGTHDQIKFLVSQGCIKPLCDLLICPDPRIVTVCLEGLENILKVGEAEKNLGATGGVNLYAQMIDEAEGLEKIENLQSHDNTEIYEKAVKILETYWLEEEDDAMPTGDAAQSGFHFGNNEQVQVPSGGFNFS

SEQ ID NO: 8232 - protein, 531 aa, Elaeis guineensis
MSLRPSERAEVRRNKYKVAVDAEEGRRRREDNMVEIRKSRREESLQKKRREGMQAQPFPPSSIHTSALEKKLESLPAMVAGVYSDDSTLQLEATTQFRKLLSIERSPPIEEVIQAGVVPRFVEFLTREDFPQLQFEAAWALTNIASGTSDNTKVVIDHGAVPIFVKLLSSPSDDVREQAVWALGNVAGDSPRCRDLVLANGALIPLLAQLNEHAKLSMLRNATWTLSNFCRGKPQPVFEQVKPALPALERLIHSNDEEVLTDACWALSYLSDGTNDKIQAVIEAGVIPRLVELLLHPSPSVLIPALRTVGNIVTGDDVQTQYVINHQALPCLLSLLTHNHKKSIKKEACWTISNITAGNKEQIQAVIAAGIIGPLVHLLQTAEFDIKKEAAWAISNATSGGTHDQIKFLVSQGCIKPLCDLLVCPDPRIVTVCLEGLENILKVGEAEKNLGTTGGVNLYAQMIDEAEGLEKIENLQSHDNTEIYEKAVKILETYWLEEEDDAMPAGDAAQTGFHFGNNEQLQVPSGGFNFS

SEQ ID NO: 8233 - protein, 529 aa, Amorphophallus konjac
MSLRPSARTEVRRNRYKVAVDAEEGRRRREDNMVEIRKSKREESLQKKRREGMQAQALAPAVHASAVEKKLESLPAMVAGVYSDDSNLQLEATTQFRKLLSIERSPPIEEVIQSGVVPRFVEFLTREDFPQLQFEAAWALTNIASGTSENTKVVIDHGAVPIFVNLLNSHSDDVREQAVWALGNVAGDSPRCRDLVLAHGALLPLLNQLNEHAKLSMLRNATWTLSNFCRGKPQPSFEQTKPALPVLVRLIHSNDEEVLTDACWALSYLSDGTNDKIQAVIEAGVCPRIVELLLHPSPSVLIPALRTVGNIVTGDDLQTQHIIDHQALSCLLNLLTHNHKKSIKKEACWTISNITAGNKEQIQAVINAGIIAPLVHLLQTAEFDIKKEAAWAISNATSGGTHDQIKYLVSQGCIKPLCDLLVCPDPRIVTVCLEGLENIIKIGEAEKNLGTTEGINLYAQMIDDAEGLEKIENLQSHDNTEIYEKAVKILETYWLEDEDDAMPTTDATQTGFRFGNSEVPVPSGGFNFG

SEQ ID NO: 8234 - protein, 530 aa, Manihot esculenta
MSLRPSARTEVRRNRYKVAVDAEEGRRRREDNMVEIRKNRREESLQKKRREGLQAQPVPAAIHSSAVEKKLEHLPSMVAGVWSEDSNLQLEATTQFRKLLSIERSPPIEEVIQAGVVPRFVEFLMREDFPQLQFEAAWALTNIASGTSENTRVVIDHGAVPIFVKLLGSPSDDVREQAVWALGNVAGDSPKCRDLVLGHGALIPLLAQLNEHAKLSMLRNATWTLSNFCRGKPQPPFDQVKPALPALAHLIHSNDEEVLTDACWALSYLSDGTNDKIQAVIEAGVCPRLVELLLHPSPSVLIPALRTVGNIVTGDDMQTQCIINHQALPCLLNLLTNNYKKSIKKEACWTISNITAGNKEQIQAVIEANIIGPLVHLLQNAEFDIKKEAAWAISNATSGGTHDQIKYLVSQGCIKPLCDLLICPDPRIVTVCLEGLENILKVGEADKNLGNTGDVNQYAQMIDDAEGLEKIENLQSHDNTEIYEKAVKILETYWLEEEDETMPPGDASQSGFQFGGSEMPAVPSGGFNFS

SEQ ID NO: 8235 - protein, 527 aa, Aquilegia formosa
MSLRPNARTEVRRNRYKVAVDAEEGRRRREDNMVEIRKNKREESLQKKRREGMQPQQFPAALHASNIEKKLESLPVMVQGVFADDNQLQLEATTQFRKLLSIERSPPIEEVIQSGVVPRFVEFLMREDFPQLQFEAAWALTNIASGTSDNTKVVIDHGAVPIFVKLLGSPSDDVREQAVWALGNVAGDSPRCRDLVLSHGALIPLLAQLNEHAKLSMLRNATWTLSNFCRGKPQPPFDQTKPALPALERLIHSNDEEVLTDACWALSYLSDGTNDKIQAVIEAGVCPRLVELLLHPSPSVLIPALRTVGNIVTGDDVQTQCIINHQALPCLLNLLTHNHKKSIKKEACWTISNITAGNKDQIQSVIAADIIGPLVHLLQTAEFDIKKEAAWAISNATSGGTHEQIKYLVVQGCIKPLCDLLVCPDPRIVTVCLEGLENILKVGETEKSLGNTGGVNVYAQYIDEAEGLEKIENLQSHDNTEIYEKAVKILETYWLEEEDEPLPPGDAAQTGFRFGGSEIPSGGFNFG

SEQ ID NO: 8236 - protein, 529 aa, Theobroma cacao
MSLRPNARTEVRRNRYKVAVDAEEGRRRREDNMVEIRKNRREESLQKKRREGLQAQPMPASLHSSAVEKKLENLPAMVAGVWSEDSNLQLESTTQFRKLLSIERSPPIEEVIQAGVVPRFVEFLMREDFPQLQFEAAWALTNIASGTSENTKVVIDHGAVPIFVKLLGSPSDDVREQAVWALGNVAGDSPRCRDLVLGHGALLPLLAQLNEHAKLSMLRNATWTLSNFCRGKPQPPFDQVKPALPALARLIHSNDEEVLTDACWALSYLSDGTNDKIQAVIEAGVCARLVELLLHPSPSVLIPALRTVGNIVTGDDLQTQCIINHQALPCLLNLLTNNFKKSIKKEACWTISNITAGNKEQIQAVIEANIIAPLVHLLQNAEFDIKKEAAWAISNATSGGTHDQIKFLVSQGCIKPLCDLLNCPDPRIVTVCLEGLENILKVGEADKNQGNTGGVNLYAQMIDDAEGLEKIENLQSHDNTEIYEKAVKVLETYWLEEEDETMPPGDASQTGFQFGPGEVHVPSGGFNFS

SEQ ID NO: 8237 - protein, 531 aa, Aristolochia fimbriata
MSLRPNARTEVRRNRYKVAVDAEEGRRRREDNMVEIRKNRREESLQKKRREGMQAQQFPTSIHASAVEKKLESLPAMVNGVWSDDSNLQLEATTQFRKLLSIERSPPIEEVIQAGVVPRFVDFLLREDFPQLQFEAAWALTNIASGTSENTKVVIDHGAVPIFVKLLGSPSDDVREQAVWALGNVAGDSPRCRDLVLGHGALIPLLAQLNEHAKLSMLRNATWTLSNFCRGKPQPPFEQTKPALPALERLIHSNDEEVLTDACWALSYLSDGTNDKIQAVIEAGVCPRLVELLMHPSPSVLIPALRTVGNIVTGDDMQTQCIINHQALPCLLNLLTHNHKKSIKKEACWTISNITAGNKEQIQAVINADIIGPLVNLLHTAEFDIKKEAAWAISNATSGGTHDQIKYLVSQGCIKPLCDLLVCPDPRIVTVCLEGLENILKVGEAEKNVGNTGGVNLYAQLIDEAEGLEKIENLQSHDNTEIYEKAVKILETYWLEEEDELPPGDAAAAAQAGGFRFGGELPVPSGGFNFS

SEQ ID NO: 8238 - protein, 532 aa, Cajanus cajan
MSYRPSGNSRTEVRRNRYKVAVDAEEGRRRREDTMVEIRKNRREESLQKKRREGLQPQQMPASVHSTLVEKKLEHLPSMVAGVWTDDNNLQLEATTQFRKLLSIERSPPIEEVIQTGVVSRFVEFLMREDFPQLQFEAAWALTNIASGTSENTKVVIDHGAVPIFVKLLASPSDDVREQAVWALGNVAGDSPRCRDLVLSHGALLPLLAQLNEHAKLSMLRNATWTLSNFCRGKPQPPFDQVKPALPALARLIHSNDEEVLTDACWALSYLSDGTNDKIQAVIEAGVCPRLVELLLHPSPSVLIPALRTVGNIVTGDDMQTQIIINHQALPCLLNLLTNNYKKSIKKEACWTISNITAGNKLQIQAVIEANIIAPLVNLLQNAEFDIKKEAAWAISNATSGGSHEQIKYLVSQGCIKPLCDLLICPDPRIVTVCLEGLENILKVGEADKNIGNTGDVNLYAQMIDDAEGLEKIENLQSHDNTEIYEKAVKILETYWLEEEDETMPPGDASQSGFNFGNSEAPSVPSGGFNFN

SEQ ID NO: 8239 - protein, 532 aa, Glycine max
MSYRPSGNSRTEVRRNRYKVAVDAEEGRRRREDTMVEIRKNRREESLQKKRREGLQPQQMPASVHSSLVEKKLEHLPSMVTGVWTDDNNLQLEATTQFRKLLSIERSPPIEEVIQTGVVSRFVEFLMREDFPQLQFEAAWALTNIASGTSENTKVVIDHGAVPIFVKLLASPSDDVREQAVWALGNVAGDSPRCRDLVLSHGALLPLLAQLNEHAKLSMLRNATWTLSNFCRGKPQPPFDQVKPALPALARLIHSNDEEVLTDACWALSYLSDGTNDKIQAVIEAGVCPRLVELLLHPSPSVLIPALRTVGNIVTGDDMQTQVIINHQALPCLLNLLTNNYKKSIKKEACWTISNITAGNKQQIQAVIEANLIAPLVNLLQNAEFDIKKEAAWAISNATSGGSHEQIKFLVSQGCIKPLCDLLICPDPRIVTVCLEGLENILKVGEADKNIGNTGDVNLYAQMIDEAEGLEKIENLQSHDNTEIYEKAVKILETYWLEEEDETMPPGDASQSGFNFGSSDAPTVPSGGFNFN

SEQ ID NO: 8240 - protein, 529 aa, Vitis vinifera
MSLRPSARTEVRRNRYKVAVDAEEGRRRREDNMVEIRKSKREESLQKKRREGLQAQQFPAAAHASTVEKKLESLPSMVAGVWSDNSSLQLEATTQFRKLLSIERSPPIEEVIQSGVVPRFVEFLVREDFPQLQFEAAWALTNIASGTSENTKVVIDHGAVPIFVKLLGSPSDDVREQAVWALGNVAGDSPRCRDLVLGHGALIPLLAQLNEHAKLSMLRNATWTLSNFCRGKPQPPFDQVKPALPALERLVHSSDEEVLTDACWALSYLSDGTNDKIQAVIEAGVCPRLVELLLHPSPSVLIPALRTVGNIVTGDDIQTQSIINHGALPCLLSLLTHNHKKSIKKEACWTISNITAGNKEQIQAVIEAGVIAPLVHLLQTAEFDIKKEAAWAISNATSGGTHEQIKYLVSQGCIKPLCDLLVCPDPRIVTVCLEGLENILKVGEAEKTLGNSGDVNYYAQLIDDAEGLEKIENLQSHDNNEIYEKAVKILETYWLEEEDETLPSGDGSQPGFQFGGNDVSVPSGGFNFS

SEQ ID NO: 8241 - protein, 531 aa, Ricinus communis
MSLRPSARTEVRRNRYKVAVDAEEGRRRREDNMVEIRKNRREESLQKKRREGLQAQPMPASLHSSAVEKKLEHLPSMVAGVWSDDSNLQLEATTQFRKLLSIERSPPIEEVIQAGVVPRFVEFLMREDFPQLQFEAAWALTNIASGTSENTRVVIDHGAVPIFVKLLASPSDDVREQAVWALGNVAGDSPKCRDLVLGNGALLPLLAQLNEHAKLSMLRNATWTLSNFCRGKPQPFFEQVKPALPALARLIHSNDEEVLTDACWALSYLSDGTNDKIQAVIEAGVCPRLVELLLHPSPSVLIPALRTVGNIVTGDDMQTQCIINHQALPCLLNLLTNNYKKSIKKEACWTISNITAGNKEQIQAVIEANIIGPLVHLLENAEFDIKKEAAWAISNATSGGTHDQIKYLVSQGCIKPLCDLLICPDPRIVTVCLEGLENILKVGEADKNLGNNDGGVNLYAQMIDDAEGLEKIENLQSHDNIEIYEKAVKILETYWLEEEDETMPPGDASQSGFQFGGSDMPTIPSGGFNFS

SEQ ID NO: 8242 - protein, 529 aa, Populus trichocarpa
MSLRPSARTEVRRNRYKVAVDAEEGRRRREDNMVEIRKNRREESLQKKRREGLQAQAMPASLHSSAAEKKLEHLPSMVAGVWTEDGNLQLEATTQFRKLLSIERSPPIEEVIQAGVVPRFVQFLMREDFPQLQFEAAWALTNIASGTSENTKVVIDHGAVPIFVQLLASPSDDVREQAVWALGNVAGDSPRCRDLVLGNGALLPLLAQLNENAKLSMLRNATWTLSNFCRGKPQPPFDQVKPALPALARLIHSDDEEVLTDACWALSYLSDGTNDKIQAVIEAGVCPRLVELLLHPSPSVLIPALRTVGNIVTGDDMQTQCIINHQALPCLLNLLANNYKKSIKKEACWTISNITAGNKEQIQAVIEANIIGPLVNLLQNAEFDIKKEAAWAISNATSGGAHEQIKYLVSQGCIKPLCDLLICPDPRIVTVCLEGLENILKVGEADKNVSETGGVNLYAQMIDDAEGLEKIENLQSHDNTEIYEKAVKILETYWLEEEDETMPPGDASQSGFQFGGEAPAVPSGGFNFS

SEQ ID NO: 8243 - protein, 532 aa, Glycine max
MSYRPSGNSRTEVRRNRYKVAVDADEGRRRREDTMVEIRKNRREESLQKKRREGFQPQQIPASVHSSLVEKKLEHLPSMVTGVWTDDNNLQLEATTQFRKLLSIERSPPIEEVIQTGVVSRFVEFLMREDFPQLQFEAAWALTNIASGTSENTKVVIDHGAVPIFVKLLASPSDDVREQAVWALGNVAGDSPRCRDLVLSHGALLPLLAQLNEHAKLSMLRNATWTLSNFCRGKPQPPFDQVKPALPALARLIHSNDEEVLTDACWALSYLSDGTNDKIQAVIEAGVCPRLVELLLHPSPSVLIPALRTVGNIVTGDDMQTQVIINHQALPCLLNLLTNNYKKSIKKEACWTISNITAGNKQQIQAVIEANLIAPLVNLLQNAEFDIKKEAAWAISNATSGGSHEQIKFLVSQGCIKPLCDLLICPDPRIVTVCLEGLENILKVGEADKNIGNTGDVNLYAQMIDEAEGLEKIENLQSHDNTEIYEKAVKILETYWLEEEDETMPPGDASQSGFNFGSSDAPAVPSGGFNFN

SEQ ID NO: 8244 - protein, 530 aa, Amorphophallus konjac
MSLRPSARTEVRRNRYKVAVDAEEGRRRREDNMVEIRKSKREESLQKKRREGMQQNQPLAPAVHASAMEKKLESLPAMVAGVYSDDRNLQLEATTQFRKLLSIERSPPIEEVIQSGVVPRFVEFLTKEDFPQLQFEAAWALTNIASGTSENTKVVIDHGAVPIFVKLLNSPNDDVREQAVWALGNVAGDSPRCRDLVLAHGALLPLLNQLNEHAKLSMLRNATWTLSNFCRGKPQPSFEQTKPALPALERLIHTTDEEVLTDACWALSYLSDGTNDKIQAVIEAGVCPRLVELLLHPSPSVLIPALRTVGNIVTGDDLQTQYIINYQALPCLLNLLTHNHKKSIKKEACWTISNITAGNKEQIQAVINVDIIGPLVHLLQTAEFDIKKEAAWAISNATSGGTHEQIKYLVNQGCIKPLCDLLVCPDPRIVTVCLEGLENILKVGEVEKNMGTTGGVNLYARMIEDAEGLEKIENLQSHDNTEIYEKAVKILETYWLEDEDDAMPTNDATQTGFNFGNSDVPVPSGGFNFG

SEQ ID NO: 8245 - protein, 530 aa, Cirsium arvense
MSLRPNARTEVRRNRYKVAVDAEEGRRRREDNMVEIRKNKREESLQKKRREVLTGSQFSVPVQSASAAEKKLENLPAMVAGVWSDDNNMQLEATTQFRKLLSIERSPPIEEVIQSGVVPRFVEFLVREDFPQLQFEAAWALTNIASGTSEHTKVVIDHGAVPIFVKLLASPSDDVREQAVWALGNVAGDSPKCRDLVLGQGALIPLLAQLNEHAKLSMLRNATWTLSNFCRGKPQPSFDQTRPALPALQQLIHSNDEEVLTDACWALSYLSDGTNDKIQAVIEANVCPRLVELLNHPSPSVLIPALRTVGNIVTGDDMQTQYIINHQALPCLLNLLSNNHKKSIKKEACWTISNITAGNKEQIQTVIEANIIGPLVHLLQNAEFDIKKEAAWAISNATSGGSHDQIKYLVSQGCIKPLCDLLVCPDPRIVTVCLEGLENILKVGEAEKNLGRSGDVNLYAQMIDDAEGLEKIENLQSHDNNEIYEKAVKLLETYWLEEEDDAMPPGETTQPGFHFEGGDVSIPNGGFNFN

SEQ ID NO: 8246 - protein, 532 aa, Cannabis sativa
MSLRPSARTEVRRNRYKVAVDAEEGRRRREDNMVEIRKNRREESLQKKRREGLPPQQLQTSIPTSAVEKKLEHLPSMVAGVWSDSDDGNLQLESTTQFRKLLSIERSPPIEEVIQSGVVPRFVEFLMREDFPQLQFEAAWALTNIASGTSENTKVVIDHGAVPIFVKLLGSPSDDVREQAVWALGNVAGDSPRCRDLVLGNGALLPLLAQLNEHAKLSMLRNATWTLSNFCRGKPQPPFDQVKPALPALARLIHSNDEEVLTDACWALSYLSDGTNDKIQAVIEAGVCPRLVELLLHPSPSVLIPALRTVGNIVTGDDLQTQVIISHQALPCLLTLLTNNYKKSIKKEACWTISNITAGNKEQIQCVVEAGIIAPLVNLLQNAEFDIKKEAAWAISNATSGGSHDQIKFLVNQGCIKPLCDLLICPDPRIVTVCLEGLENILKVGEAEKNLGNTGGVNLYAQLIDDAEGLEKIENLQSHDNTEIYEKAVKILETYWLEEEDDTMPPGDSAQSGFNFGGSEVPAVPSGGFNFS

SEQ ID NO: 8247 - protein, 529 aa, Euphorbia peplus
MSLRPSARTEVRRNRYKVAVDAEEGRRRREDNMVEIRKNRREESLQKKRREGLQSQPMPASLHSSAVEKRLEHLPSMVAGVWSDDGNLQLEATTQFRKLLSIERSPPIEEVIQAGVVPRFVEFLMREDFPQLQFEAAWALTNIASGTSENTRVVIDHGAVPIFVKLLASPSDDVREQAVWALGNVAGDSPKCRDLVLGNGALLPLLSQLNEHAKLSMLRNATWTLSNFCRGKPQPPFEQVKPALPALARLIHSNDEEVLTDACWALSYLSDGTNDKIQAVIEAGVCPRLVELLLHQSPSVLIPALRTVGNIVTGDDTQTQCIINHQALPCLLNLLTNNYKKSIKKEACWTISNITAGNKEQIQCVIESNIIGPLVHLLQNAEFDIKKEAAWAISNATSGGAHEQIKYLVSQGCIKPLCDLLICPDPRIVTVCLEGLENILKVGESDKNLGANGGVNIYAQMIDDAEGLEKIENLQSHDNTEIYEKAVKILEAYWLEEDETMPPGDASQSGFQFGGNEMPAVPSGGFNFS

SEQ ID NO: 8248 - protein, 531 aa, Arnica chamissonis
MSLRPSERTEVRRNRYKVAVDADEGRRRREDNMVEIRKNRREESLQKKRREGLAASQFPLPVQSASAAEKKLENLPAMVAGVWSDDNNMQLEATTQFRKLLSIERSPPIEEVIQAGAVPRFVEFLVREDFPQLQFEAAWALTNIASGTSEHTKVVIDHGAVPVFVKLLASPSDDVREQAVWALGNVAGDSPKCRDLVLGQGALIPLLAQLNEHAKLSMLRNATWTLSNFCRGKPQPSFEQTRPALPALQQLIHSNDEEVLTDACWALSYLSDGTNDKIQAVIEANVCPRLVELLNHPSPSVLIPALRTVGNIVTGDDMQTQYIINHQALPCLLNLLSNNHKKSIKKEACWTISNITAGNKDQIQTVIDSNIIGPLVQLLQNAEFDIKKEAAWAISNATSGGSHDQIKYLVSQGCIKPLCDLLVCPDPRIVTVCLEGLENILKVGEAEKNLGTSGEVNVYAQMIDDAEGLEKIENLQSHDNTEIYEKAVKLLETYWLEEEEDDVMPPGETAQPGFHFGGGDVSVPNGGFNFN

SEQ ID NO: 8249 - protein, 531 aa, Cirsium arvense
MSLRPSARTEVRRNRYKVAVDAEEGRRRREDNMVEIRKNKREESLQKKRREALTGSQFSVPVQSASAAEKKLENLPAMVAGVWSDDNNMQLEATTQFRKLLSIERSPPIEEVIQSGVVPRFVEFLVREDFPQLQFEAAWALTNIASGTSEHTKVVIDHGAVPIFVKLLASPSDDVREQAVWALGNVAGDSPKCRDLVLGQGALIPLLAQLNEHAKLSMLRNATWTLSNFCRGKPQPSFDQTRPALPALQQLIHSNDEEVLTDACWALSYLSDGTNDKIQAVIEANVCPRLVELLNHPSPSVLIPALRTVGNIVTGDDMQTQYIINHQALPCLLNLLSNNHKKSIKKEACWTISNITAGNKEQIQTVIEANIIGPLVHLLQNAEFDIKKEAAWAISNATSGGSHDQIKYLVSQGCIKPLCDLLICPDPRIVTVCLEGLENILKVGEAEKNLGRSGDVNLFAQMIDDAEGLEKIENLQSHDNNEIYEKAVKLLETYWLEEEDDAMPPGSDAAQPGFQFGGADVSVPSGGFNFN

SEQ ID NO: 8250 - protein, 527 aa, Vitis vinifera
MSLRPSARTEVRRNRYKVSVDAEEGRRRREDNMVEIRKNRREESLQKKRREGLQAQTLPASIHSAAVEKKLEFLPSMVAGVWTDDSNIQLEATTQFRKLLSIERCPPIEEVIQSGVVPRFVEFLVREDFPQLQFEAAWALTNIASGTSDNTKVVIDHGAVPVFVKLLGSPSDDVREQAVWALGNVAGDSPRCRDLVLGHGALLPLLAQLNEHAKLSMLRNATWTLSNFCRGKPQPPFDQTKPALPALERLIHSNDEEVLTDACWALSYLSDGTNDKIQAVIEAGVCPRLVELLLHPSPSVLIPALRTVGNIVTGDDMQTQCIINHQALPCLLNLLTNNHKKSIKKEACWTISNITAGNKEQIQAVIEANIIGPLVHLLQNAEFDIKKEAAWAISNATSGGSHEQIKYLVSQASIKPLCDLLVCPDPRIVTVCLEGLENILKVGEAEKNLGSTREVNLYAQMIDDAEGLEKIENLQSHDNTEIYEKAVKILETYWLEEEDETMPPGDSSQPGFRFGEVPVPTGGFNFS

SEQ ID NO: 8251 - protein, 527 aa, Cajanus cajan
MSLRPNARTEVRRNRYKVAVDADEGRRRREDNMVEIRKSKREESLLKKRREGLQQFPAPLQNSTVDKKLESLPAMVTGVWSDDNSLQLEATTQFRKLLSIERSPPIEEVIQAGVVPRFVEFLVREDFPQLQFEAAWALTNIASGTSENTKVVIDHGAVPIFVKLLSSPSDDVREQAVWALGNVAGDSPRCRDLVLSNGALIPLLAQLNEHAKLSMLRNATWTLSNFCRGKPQPPFEQVRPALPALERLVFSNDEEVLTDACWALSYLSDGTNDKIQAVIEAGVCGRLVQLLMHPSPSVLIPALRTVGNIVTGDDMQTQSIINHGALPCLLNLLTHNHKKSIKKEACWTISNITAGNKEQIQAVIEAALIAPLVNLLQNAEFDIKKEAAWAISNATSGGTHDQIKYLVSQGCIKPLCDLLVCPDPRIVTVCLEGLENILKVGEAEKSLGNTGDANLYAQMIDDAEGLEKIENLQSHDNNEIYEKAVKILETYWLEDEDETLPSGDGAQAGFNFGSNELPVPSGGFNFS

SEQ ID NO: 8252 - protein, 530 aa, Centaurea maculosa
MSVRPNARTEVRRNRYKVAVDAEEGRRRREDNMVEIRKNKREESLQKKRREVLTGSQFSVPVQSASAAEKKLENLPAMVAGVWSDDNNMQLEATTQFRKLLSIERSPPIEEVIQSGVVPRFVEFLVREDFPQLQFEAAWALTNIASGTSEHTKVVIDHGAVPIFVKLLASPSDDVREQAVWALGNVAGDSPKCRDLVLGQGALIPLLAQLNEHAKLSMLRNATWTLSNFCRGKPQPSFDQTRPALPALQQLIHSNDEEVLTDACWALSYLSDGTNDKIQAVIEANVCPRLVELLNHPSPSVLIPALRTVGNIVTGDDMQTQYIINHQALPCLLNLLSNNHKKSIKKEACWTISNITAGNKEQIQTVIEANIIGPLVHLLQNAEFDIKKEAAWAISNATSGGSHDQIKYLVSQGCIKPLCDLLVCPDPRIVTVCLEGLENILKVGEAEKNLGRSGDVNLYAQMIDDAEGLEKIENLQSHDNNEIYEKAVKLLETYWLEEEDDAMPPGETTQPGFHFEGGDVSIPSGGFNFN

SEQ ID NO: 8253 - protein, 529 aa, Populus trichocarpa
MSLRPSARTEVRRNRYKVAVDADEGRRRREDNMVEIRKNRREESLQKKRREGLQAQAIPAALHSSAAEKKLEHLPSMVAGVWSEDGNLQLEATTQFRKLLSIERSPPIEEVIQAGVVPRFVQFLMREDFPQLQFEAAWALTNIASGTSENTKVVIDHGAVPIFVQLLGSPSDDVREQAVWALGNVAGDSPRCRDLVLGHGALLPLLAQLNENAKLSMLRNATWTLSNFCRGKPQPPFDQVKPALPALARLIHSNDEEVLTDACWALSYLSDGTNDKIQAVIEAGVCPRLIELLLHPSPSVLIPALRTVGNIVTGDDMQTQCIINHQSLPCLLNLLTNNYKKSIKKEACWTISNITAGNKEQIQAVIEANLIGPLVHLLQNAEFDIKKESAWAISNATSGGTHEQIKYLVSQGCIKPLCDLLICPDPRIVTVCLEGLENILKVGEADKNVSDTGGVNLYAQMIDDAEGLEKIENLQSHDNSEIYEKAVKILETYWLEEDDETMPPGDASQSGFQFGGDAPAVPSGGFNFG

SEQ ID NO: 8254 - protein, 529 aa, Euphorbia esula
  misc_feature (28)..(28): Xaa can be any naturally occurring amino acid
  misc_feature (131)..(131): Xaa can be any naturally occurring amino acid
  misc_feature (145)..(145): Xaa can be any naturally occurring amino acid
  misc_feature (204)..(204): Xaa can be any naturally occurring amino acid
  misc_feature (445)..(445): Xaa can be any naturally occurring amino acid
MSLRPSARTEVRRNRYKVAVDAEEGRRXREDNMVEIRKNRREESLQKKRREGLQSQPMPASLHSSAVEKRLEHLPSMVAGVWSDDSNLQLEATTQFRKLLSIERSPPIEEVIQAGVVPRFVEFLMREDFPXLQFEAAWALTNIAXGTSENTRVVIDHGAVPIFVKLLASPSDDVREQAVWALGNVAGDSPKCRDLVLGNGALLXLLSQLNEHAKLSMLRNATWTLSNFCRGKPQPSFDQVKPALPALARLIHSNDEEVLTDACWALSYLSDGTNDKIQAVIEAGVCPRLVELLLHPSPSVLIPALRTVGNIVTGDDMQTQCIINHQALPCLLNLLTNNYKKSIKKEACWTISNITAGNKEQIQCVIEANIIGPLVHLLQNAEFDIKKEAAWAISNATSGGAHEQIKYLVSQGCIKPLCDLLICPDPRIVTVCLEGLENILKVGEXDKNLGENGGVNIYAQMIDDAEGLEKIENLQSHDNTEIYEKAVKILEAYWLEEDETMPPGDASQSGFQFGGNEMPAVPSGGFNFS

SEQ ID NO: 8255 - protein, 531 aa, Cirsium arvense
MSLRPNARTEVRRNRYKVAVDAEEGRRRREDNMVEIRKNKREESLQKKRREVLTGSQFSVPVQSASAAEKKLENLPAMVAGVWSDDNNMQLEATTQFRKLLSIERSPPIEEVIQSGVVPRFVEFLVREDFPQLQFEAAWALTNIASGTSEHTKVVIDHGAVPIFVKLLASPSDDVREQAVWALGNVAGDSPKCRDLVLGQGALIPLLAQLNEHAKLSMLRNATWTLSNFCRGKPQPSFDQTRPALPALQQLIHSNDEEVLTDACWALSYLSDGTNDKIQAVIEANVCPRLVELLNHPSPSVLIPALRTVGNIVTGDDMQTQYIINHQALPCLLNLLSNNHKKSIKKEACWTISNITAGNKEQIQTVIEANIIGPLVHLLQNAEFDIKKEAAWAISNATSGGSHDQIKYLVSQGCIKPLCDLLICPDPRIVTVCLEGLENILKVGEAEKNLGRSGDVNLFAQMIDDAEGLEKIENLQSHDNNEIYEKAVKLLETYWLEEEDDAMPPGSDAAQPGFQFGGADVSVPSGGFNFN

SEQ ID NO: 8256 - protein, 529 aa, Tabernaemontana elegans
MSLRPNARTEVRRNRYKVAVDAEEGRRRREDGMIEIRKSRREESLLKKRREGLQAQQFQNTVNLTQLEKKLESLPAMVAGVWSNDSSLQLEATTQFRKLLSIERNPPIEEVIQSGVVPRFVEFLARDDYPQLQFEAAWALTNIASGTSENTKVVIDHGAVPIFVRLLSSPSDDVREQAVWALGNVAGDSPKCRDLVLNYGALMPLLAQFNEHAKLSMLRNATWTLSNFCRGKPQPQFEQTKPALPTLARLIHSNDEEVLTDACWALSYLSDGTNDKIQAVIEAGVCPRLVELLLHPSPSVLIPALRTVGNIVTGDDIQTQVIIDNEALPCLLNLLTQNYKKSIKKEACWTISNITAGNREQIQAVIQAGIIAPLVQLLQNAEFEIKKEAAWAISNATSGGTHEQIKFLVSQGCIKPLCDLLVCPDPRIVTVCLEGLENILKVGEAEKNLGNTGDVNVFAQMIDEAEGLEKIENLQSHDNNEIYEKAVKILETYWLEEDDEQLPSGDAPQSGFNFGGGDLPVPSGGFKFG

SEQ ID NO: 8257 - protein, 531 aa, Flaveria ramosissima
MSLRPSERTDARRNRYKVAVDADEGRRRREDNMVEIRKNRREESLQKKRREGLAANQFPLPVQSASAAEKKLENLPAMVAGVWSDDNNMQLEATTQFRKLLSIERSPPIEEVIQAGVVPRFVEFLMREDFPQLQFEAAWALTNIASGTSDHTKVVIDHGAVPIFVKLLASPSDDVREQAVWALGNVAGDSPKCRDLVLGQGALIPLLAQLNEHAKLSMLRNATWTLSNFCRGKPQPSFDQTRPALPALQQLIHSNDEEVLTDACWALSYLSDGTNDKIQAVIEANVCPRLVELLNHPSPSVLIPALRTVGNIVTGDDMQTQYIINHQALPCLLNLLINNHKKSIKKEACWTISNITAGNKEQIQTVIDANIIGPLVHLLQNAEFDIKKEAAWAISNATSGGSHDQIKYLVSQGCIKPLCDLLVCPDPRIVTVCLEGLENILKVGEAEKNLGRSGNINLYAQMIDDAEGLEKIENLQSHDNNEIYEKAVKLLETYWLEEEEEDVMPPGEPAQPGFNFGGGDVSVPNGGFNFN

SEQ ID NO: 8258 - protein, 532 aa, Humulus lupulus
MSLRPSARTEVRRNRYKVAVDAEEGRRRREDNMVEIRKNRREESLQKKRREGLQPQQLQTSIPTLAVEKKLEHLPSMVAGVWSDSDDGNLQLESTTQFRKLLSIERSPPIEEVIQSGVVPRFVEFLMREDFPQLQFEAAWALTNIASGTSENTKVVIDHGAVPIFVKLLGSPSDDVREQAVWALGNVAGDSPRCRDLVLGNGALHPLLAQLNEHAKLSMLRNATWTLSNFCRGKPQPPFDQVKPALPALARLIHSNDEEVLTDACWALSYLSDGTNDKIQAVIEAGVCPRLVELLLHPSPSVLIPALRTVGNIVIGDDLQTQVIINHQALPCLLTLLTNNYKKSIKKEACWTISNITAGNKDQIQCVVEAGIIAPLVNLLQNAEFDIKKEAAWAISNATSGGSHDQIKFLVNQGCIKPLCDLLICPDPRIVTVCLEGLENILKVGEAEKNLGNTGGVNLYAQLIDDAEGLEKIENLQSHDNTEIYEKAVKILETYWLEEEDDTMPPGDSSQSGFNFGGSEVPAVPSGGFNFS

SEQ ID NO: 8259 - protein, 533 aa, Medicago truncatula
MSYRPNANSRTEVRRNRYKVAVDAEEGRRRREDTMVEIRKNRREESLLKKRREGLQPQQIPSALHSNVVEKKLEHLPTMVAGVWSDDNNLQLESTTQFRKLLSIERTPPIEEVIQTGVVSRFVEFLMREDFPQLQFEAAWALTNIASGTSENTKVVIDHGAVPIFVKLLASSSDDVREQAVWALGNVAGDSPRCRDLVLGHGALVPLLAQLNEHAKLSMLRNATWTLSNFCRGKPQPPFDQVKPALPALAGLIHSNDEEVLTDACWALSYLSDGTNDKIQAVIEAGVCPRLVELLLHPSPSVLIPALRTVGNIVTGDDLQTQVIINHQALPCLYNLLTNNYKKSIKKEACWTISNITAGNKQQIQAVIEANIFGPLVSLLQNAEFDIKKEAAWAISNATSGGSHEQIKYLVSQGCIKPLCDLLICPDPRIVTVCLEGLENILKVGEADKNIGNNGDVNLYAQMIDDAEGLEKIENLQSHDNTEIYEKAVKILETYWLEEEDETMPPGDASQSGFNFGSAEVPSVPSGGFNFNQ

SEQ ID NO: 8260 - protein, 526 aa, Lactuca sativa
MSLRPSARTEVRRNRYKVAVDAEEGRRRREDNMVEIRKNRREESLQKKRREALTGSQFAVPVQSASAAEKKLENLPAMVAGVFSDDNNMQLEATTQFRKLLSIERSPPIEEVIQSGVVPRFVEFLVREDFPQLQFEAAWALTNIASGTSEHTKVVIDHGAVPIFVKLLASPSDDVREQAVWALGNVAGDSPKCRDLVLAQGALIPLLSQLNEHAKLSMLRNATWTLSNFCRGKPQPSFSQTKPALPALQQLIHSNDEEVLTDACWALSYLSDGTNDKIQAVIEANVCPRLVELLNHPSPSVLIPALRTVGNIVTGDDMQTQYIINHQALPCLLNLLTNNHKKSIKKEACWTISNITAGNKEQIQTVIEANIIGPLIHLLQNAEFDIKKEAAWAISNATSGGSHDQIKYLVAQGCIKPLCDLLICPDPRIVTVCLEGLENILKVGEAEKNLGRSGDVNLYAQMIDDAEGLEKIENLQSHDNNEIYEKAVKLLETYWLEEEDDAMPPGDAARTQPAGRFHFGGGDVSV

SEQ ID NO: 8261 - protein, 531 aa, Cirsium arvense
MSLRPSARTEVRRNRYKVAVDAEEGRRRREDNMVEIRKNKREESLQKKRREALTGSQFSVPVQSASAAEKKLENLPAMVAGVWSDDNNMQLEATTQFRKLLSIERSPPIEEVIQSGVVPRFVEFLVREDFPQLQFEAAWALTNIASGTSEHTKVVIDHGAVPIFVKLLASPSDDVREQAVWALGNVAGDSPKCRDLVLGQGALIPLLAQLNEHAKLSMLRNATWTLSNFCRGKPQPSFDQTRPALPALQQLIHSNDEEVLTDACWALSYLSDGTNDKIQAVIEANVCPRLVELLNHPSPSVLIPALRTVGNIVTGDDMQTQYIINHQALPCLLNLLSNNHKKSIKKEACWTISNITAGNKEQIQTVIEANIIGPLVHLLQNAEFDIKKEAAWAISNATSGGSHDQIKYLVSQGCIKPLCDLLICPDPRIVTVCLEGLENILKVGEAEKNLGRSGDVNLFAQMIDDAEGLEKIENLQSHDNNEIYEKAVKLLETYWLEEEDDVMPPGDNTTQSGFQFGGADVSVPSGGFNFN

SEQ ID NO: 8262 - protein, 530 aa, Unknown
  Sequence found in Organisms: Cucumis melo, Citrullus lanatus
MSLRPTARTEVRRNRYKVSVDAEEGRRRREDNMVEIRKSKREESLQKKRREGLQAQQFPSAVHTSTVEKKLESLPSMVAGVWSDNSSLQLEATTQFRKLLSIERSPPIEEVIQSGVVPRFVEFLVREDFPQLQFEAAWALTNIASGTSEHTKVVIDHGAVPIFVKLLASPSDDVREQAVWALGNVAGDSPTCRDLVLRHGALIPLLSQLNEHAKLSMLRNATWTLSNFCRGKPQPPFDQVKPALPALERLVHSNDEEVLTDACWALSYLSDGTNDKIQAVIEAGVCGRLVQLLLHPSPSVLIPALRTVGNIVTGDDIQTQCIINDGALPCLLSLLTHNHKKSIKKEACWTISNITAGNKEQIQAVIEAGLIPPLVNLLQNAEFDIKKEAAWAISNATSGGTHEQIKYLVSQGCIKPLCDLLVCPDPRIVTVCLEGLENILKVGEAEKNLGTNGDVNLYAQMIDDAEGLEKIENLQSHDNHEIYEKAVKILETYWLEEEDEALPTTDGGAQPGFRFGGNELPVPSGGFNFS

SEQ ID NO: 8263 - protein, 531 aa, Glycine max
MSLRPNARTEVRRNRYKVAVDADEGRRRREDNMVEIRKSKREESLQKKRREGLQAQQQFPTPLQAASIVEKKLESLPAMVAGVWSDDNSQQLEATTQFRKLLSIERSPPIEEVIQAGVVPRFVEFLVREDFPQLQFEAAWALTNIASGTSENTKVVIDHGAVPIFVKLLSSPSDDVREQAVWALGNVAGDSPKCRDLVLSHGALIPLLAQLNEHAKLSMLRNATWTLSNFCRGKPQPPFEQVRAALPALERLVFSNDEEVLTDACWALSYLSDGTNDKIQAVIEAGVCPRLVQLLLHPSPSVLIPALRTVGNIVTGDDMQTQTIINHGALPCLLSLLTHNHKKSIKKEACWTISNITAGNRDQIQAVVEAGLIAPLVNLLQNAEFDIKKEAAWAISNATSGGTHEQIKYLVSQGCIKPLCDLLVCPDPRIVTVCLEGLENILKVGEAEKSMGNSGDVNLYAQMIDEAEGLEKIENLQSHDNNEIYEKAVKILETYWLEDDDETLPTGDGAQPGFNFGNNDVPVPSGGFNFS

SEQ ID NO: 8264 - protein, 531 aa, Glycine max
MSLRPNARTEVRRNRYKVAVDADEGRRRREDNMVEIRKSKREESLQKKRREGLQAQQQFPTPLQASSIVEKKLESLPAMVAGVWSDDNSQQLEATTQFRKLLSIERSPPIEEVIQAGVVPRFVEFLVREDFPQLQFEAAWALTNIASGTSENTKVVIDHGAVPIFVKLLSSPSDDVREQAVWALGNVAGDSPRCRDLVLSHGALIPLLAQLNEHAKLSMLRNATWTLSNFCRGKPQPPFEQVRAALPALERLVFSNDEEVLTDACWALSYLSDGTNDKIQAVIEAGVCPRLVQLLLHPSPSVLIPALRTVGNIVTGDDMQTQTIINHGALPCLLSLLTHNHKKSIKKEACWTISNITAGNRDQIQAVIEAGLIAPLVNLLQNAEFDIKKEAAWAISNATSGGTHEQIKYLVSQGCIKPLCDLLVCPDPRIVTVCLEGLENILKVGEAEKSLGNTGDVNLYAQMIDEAEGLEKIENLQSHDNNEIYEKAVKILETYWLEDDDETLPAGDGAQPGFNFGNNDLPVPSGGFNFS

SEQ ID NO: 8265 - protein, 530 aa, Helianthus annuus
MSLRPSERTEVRRNRYKVAVDADEGRRRREDNMVEIRKNRREESLQKKRREGLVGNQFPLPVQSSSVAEKKLENLPAMVAGIYSDDINMQLEATTQFRKLLSIERSPPIEEVIHAGVVLHFVQFLMREEFPQLQFEAAWALTNIASGTSEHTKVVIDHGAVPIFVKLLASPSDDVREQAVWALGNVAGDSPKCRDLVLGQGALLPLLALLNENAKLSMLRNATWTLSNFCRGKPQPAFEQTRPALPALQQLIHSTDEEVLTDACWALSYLSDGTNDKIQAVIEANVCPRLVELLNHPSPSVLIPALRTVGNIVTGDDMQTQYIIDHQALPCLLNLLINNHKKSIKKEACWTISNITAGNKEQIQTVIEANLVAPLVQLLQHAEFDIKKEAAWAISNATSGGSHDQIKYLVIQGCIKPLCDLLVCPDPRIVTVCLEGLENILKVGEAEKNLGRTEDTNLYAQMIDDAEGLEKIENLQSHDNNEIYEKAVKLLETYWLEEEDDVMPPGEVAQPGFNFGGGDVVVPNGGFNFN

SEQ ID NO: 8266 - protein, 530 aa, Glycine max
MSLRPNARTEIRRNRYKVAVDADEGRRRREDNMVEIRKSKREESLLKKRREGLQAQQQFPAPLQNSTVDKKLESLPAMVAGVWSDDNSIQLEATTQFRKLLSIERSPPIEEVIQAGVVPRFVEFLVREDFPQLQFEAAWALTNIASGTSENTKVVIDHGAVPIFVKLLSSPSDDVREQAVWALGNVAGDSPRCRDLVLSQGALVPLLAQLNEHAKLSMLRNATWTLSNFCRGKPQPPFEQVRPALPALERLVFSNDEEVLTDACWALSYLSDGTNDKIQAVIEAGVCARLVQLLIHPSPSVLIPALRTVGNIVTGDDMQTQCIINHGALPCLLNLLTNNHKKSIKKEACWTISNITAGNKEQIQTVIEAGLVAPLVNLLQNAEFDIKKEAAWAISNATSGGIHEQIKYLVSQGCIKPLCDLLVCPDPRIVTVCLEGLENILKVGEAEKSLGNTGDVNEYAQMIDDAEGLEKIENLQSHDNNEIYEKAVKILETYWLEEEDETLPSGDGAQPGFNFGNNELPVPSGGFNFS

SEQ ID NO: 8267 - protein, 529 aa, Catharanthus roseus
MSLRPNARTEVRRSRYKVAVDAEEGRRRREDGMIEIRKNRREENLLKKRREGLQAQQFQNSVNVTQLEKKLESLPAMVAGVWSSDSNLQLEATTQFRKLLSIERNPPIEEVIQSGVVPRFVEFLARDDYPQLQFEAAWALTNIASGTSENTKVVIDHGAVPIFVRLLSSQSDDVREQAVWALGNVAGDSPKCRDLVLNHGALMPLLAQFNEHAKLSMLRNATWTLSNFCRGKPQPQFEQTKPALPTLARLIHSNDEEVLTDACWALSYLSDGTNDKIQAVIEAGVCPRLVELLLHPSPSVLIPALRTVGNIVTGDDIQTQVIIDNEALPCLLNLLTQNHKKSIKKEACWTISNITAGNREQIQAVIQAGIIAPLVQLLQNAEFEIKKEAAWAISNATSGGTHEQIKFLVSQGCIKPLCDLLVCPDPRIVTVCLEGLENILKVGEAEKNLGNTGDVNVFAQMIDEAEGLEKIENLQSHDNNEIYEKAVKILETYWLEEDDEQLPSGDTPQSGFSFGGGELPVPSGGFQFG

SEQ ID NO: 8268 - protein, 529 aa, Vinca minor
MSLRPNARTEVRRSRYKVAVDAEEGRRRREDGMVEIRKNRREESLLKKRREGLQAQQFQNTVNVTQLEKKLESLPAMVAGVWSNDGNLQLEATTQFRKLLSIERNPPIEEVIQSGVVPRFVEFLARDDYPQLQFEAAWALTNIASGTSENTKVVMEHGAVPIFVRLLSSQSDDVREQAVWALGNVAGDSPKCRDLVLGYGALMPLLAQFNEHAKLSMLRNATWTLSNFCRGKPQPQFEQTKPALPTLARLIHSNDEEVLTDACWALSYLSDGTNDKIQAVIEAGVCPRLVELLLHPSPSVLIPALRTVGNIVTGDDAQTQLIIDNEALPCLLNLLTQSHKKSIKKEACWTISNITAGNKDQIQAVIQAGIFAPLVQLLQNAEFEIKKEAAWAISNATSGGTDEQIKYLVSQGCIKPLCDLLVCPDPRIVTVCLEGLENILKVGEAEKNLGTTGDVNVFAQMIDEAEGLEKIENLQSHDNNEIYEKAVKILETYWLEEDDEQLPSGDAPQPAFNFGGSELPVPSGGFKFG

SEQ ID NO: 8269 - protein, 529 aa, Phaseolus coccineus
MSLRPNARTEVRRNRYKVAVDADEGRRRREDNMVEIRKSKREESLQKKRREGLQTQQQFPTPLQTSIVEKKLESLPAMVAGVWSDDNSQQLEATTQFRKLLSIERSPPIEEVIQAGVVPRFVEFLVREDFPQLQFEAAWALTNIASGTSENTKVVIDHGAVPIFVKLLSSPSDDVREQAVWALGNVAGDSPRCRDLVLGHGALIPLLAQLNEHAKLSMLRNATWTLSNFCRGKPQPPFEQVRAALPALERLVFSNDEEVLTDACWALSYLSDGTNDKIQAVIEAGVCGRLVQLLLHPSPSVLIPALRTVGNIVTGDDLQTQTIINHGALPCLLSLLTHNHKKSIKKEACWTISNITAGNREQIQAVIEAGLIAPLVNLLQNAEFDIKKEAAWAISNATSGGTHEQIKYLVSQGCIKPLCDLLVCPDPRIVTVCLEGLENILKVGEAEKSLGNTGDVNLYAQMIDDAEGLEKIENLQSHDNNEIYEKAVKILETYWLEDDDDTLPTGDGAQPGFNFGNELPVPSGGFNFS

SEQ ID NO: 8270 - protein, 531 aa, Flaveria ramosissima
MSLRPSERTDARRNRYKVAVDADEGRRRREDNMVEIRKNRREESLQKKRREGLAASQFPLPVQSASAAEKKLENLPAMVAGVWSDDNNMQLEATTQFRKLLSIERSPPIEEVIQAGVVPRFVEFLMREDFPQLQFEAAWALTNIASGTSDHTKVVIDHGAVPIFVKLLASPSDDVREQAVWALGNVAGDSPRCRDLVLGQGALIPLLAQLNEHAKLSMLRNATWTLSNFCRGKPQPSFDQTRPALPALQQLIHSNDEEVLTDACWALSYLSDGTNDKIQAVIEANVCPRLVELLNHPSPSVLIPALRTVGNIVTGDDMQTQYIINHQALPCLLKLLINNHKKSIKKEACWTISNITAGNKEQIQTVIDANIIGPLVHLLQNAEFDIKKEAAWAISNATSGGSHDQIKYLVSQGCIKPLCDLLVCPDPRIVTVCLEGLENILKVGESEKNLGRSGDVNLYAQLIDDAEGLEKIENLQSHDNNEIYEKAVKLLETYWLEEEEEDVMPPGETAQPGFNFGGGDVSVPNGGFNFN

SEQ ID NO: 8271 - protein, 529 aa, Citrullus lanatus
MSLRPNERAEVRRNRYKVAVDADEGRRRREDNMVEIRKNRREESLQKKRREGLQAQQLQTSTHSSVVEKKLEHLPSMVAGVWSDDGSLQLESTTQFRKLLSIERSPPIEEVIQAGVVPRFVEFLMREDFPQLQFEAAWALTNIASGTSENTKVVIDHGAVPIFVKLLGSPSDDVREQAVWALGNVAGDSSRCRDLVLGHGALLPLLAQLNEQAKLSMLRNATWTLSNFCRGKPQPAFDLVKPALPALARLIHSNDEEVLTDACWALSYLSDGTNDKIQAVIEAGVCPRLVELLMHPAPSVLIPALRTVGNIVTGDDLQTQVIIQHNALPCLLNLLTNNHKKSIKKEACWTISNITAGNKAQIQAVIDANIVAPLVHLLQNAEFDIKKEAAWAISNATSGGSHDQIKYLVSQGCIKPLCDLLICPDPRIVTVCLEGLENILKVGEAEKNTSDTGGVNLYAQLIDDAEGLEKIENLQSHDNTEIYEKAVKILETYWLEEEDETMPPGTASQAGFSFGGDRPVVPSGGFNFG

SEQ ID NO: 8272 - protein, 529 aa, Prunus persica
MSLRPSARTEVRRNRYKVAVDAEEGRRRREDNMVEIRKSKREESLLKKRREGLQSQQFAPALQPSNVEKKLESLPSMVSGVWSDNNNLQLEATTQFRKLLSIERSPPIEEVIQSGVVPRFVEFLMREDFPQLQFEAAWALTNIASGTSENTKVVIEHGAVPIFVKLLASPSDDVREQAVWALGNVAGDSPRCRDLVLGNGALMPLLAQLNEHAKLSMLRNATWTLSNFCRGKPQPPFDQVRPALPALECLVHSNDEEVLTDACWALSYLSDGTNDKIQAVIEAGVCTRLVQLLLHPSPSVLIPALRTVGNIVTGDDLQTQCIINNGALPCLLSLLTHNHKKSIKKEACWTISNITAGNREQIQSVIDASLIGPLVNLLQNAEFDIKKEAAWAISNATSGGTPEQIKYLVGEGCIKPLCDLLVCPDPRIVTVCLEGLENILKVGEAEKNAGNTGEVNLYAQLIDDAEGLEKIENLQSHDNTEIYEKAVKILETYWVEEDDETLPSGDGSQPGFHFGGNELQVPSGGFNFS

SEQ ID NO: 8273 - protein, 532 aa, Sequoia sempervirens
MSLRPVSRTEVRRKNYKVAVDADEARRKREDNMVEIRKNKREESLLKKRREGMQAQQFAPAVQSSAVEKKLESLPAMVAGVWSDDPSLQLEATTQFRKLLSIERSPPIEEVIEAGVVPRFVEFLTRQDFPQLQFEAAWALTNIASGTSDHTRVVIDHGAVPIFVQLLSSPSDDVREQAVWALGNVAGDSPKCRDLVLSHGALMPLLAQLNEHAKLSMLRNATWTLSNFCRGKPQPAFEQTKPALPALERLIHSNDEEVLTDACWALSYLSDGTNDKIQAVIEAGVCRRLVELLLHPSPSVLIPALRTVGNIVTGDDMQTQYIINNQALPCLLALLTHNHKKSIKKEACWTISNITAGNKEQIQAVIDANIIPPLVQLLQTAEFDIKKEAAWAISNATSGGTHEQIKYLVNQGCIKPLCDLLVCPDPRIITVCLEGLENILKVGEAEKDLGNTGGVNLYAQYIDDAEGLEKIENLQSHDNNEIYEKAVKILETYWLEDEEDDQALPAGSDAAQPTFNFGANQPTVPSGGFNFG

SEQ ID NO: 8274 - protein, 530 aa, Chelidonium majus
MSLRPNARTEVRRNRYKVAVDADEGRRRREDNMVEIRKNKREESLQKKRREGMQAQQFPSAIQGTAVEKKLESLPSMVAGVWSEERELQLEATTQFRKLLSIERSPPIEEVIQSGVVPRFVEFLMREDYPQLQFEAAWALTNIASGTSENTKVVIDHGAVPIFVKLLASQSDDVREQAVWALGNVAGDSPRCRDLVLGHGALLPLLAQLNEHAKLSMLRNATWTLSNFCRGKPQPPFEQTRPALPALERLIHSTDEEVLTDACWALSYLSDGTNDKIQAVIEAGVCPRLVELLLHPSPSVLIPALRTVGNIVTGDDVQTQIIINHQALPCLLNLLTNNHKKSIKKEACWTISNITAGNKDQIQAVIAADIIGPLINLLQTAEFDIKKEAAWAISNATSGGTHEQIKYLVAQGCIKPLCDLLVCPDPRIVTVCLEGLENILKVGEAEKNLGNSGDVNIYAQLIDDAEGLEKIENLQSHDNTEIYEKAVKILETYWLEEDDEPLPPGDAAAQPGFRFGGNELPVPSGGFNFS

SEQ ID NO: 8275 - protein, 530 aa, Prunus persica
MSLRPNARAEVRRNRYKVAVDAEEGRRRREDNMVEIRKNRREESLQKKRREGLQPPQLSSNLHSSGLEKKLEHLPSMVAGVWSDESSLQLEATTQFRKLLSIERSPPIEEVIQSGVVPRFVEFLMREDFPQLQFEAAWALTNIASGTSENTKVVIDHGAVPIFVKLLSSPSDDVREQAVWALGNVAGDSPRCRDLVLGNGALIPLLSQLNEHAKLSMLRNATWTLSNFCRGKPQPPFDQVKPALPALARLIHSNDEEVLTDACWALSYLSDGTNDKIQAVIESGVCPRLVELLLHPSPSVLIPALRTVGNIVTGDDMQTQVIIQHQALPCLLTLLTNNYKKSIKKEACWTISNITAGNKDQIKAVIDAGIIGPLVSLLQGAEFDIKKEAAWAISNATSGGSHEQIKILVDQGCIKPLCDLLICPDPRIVTVCLEGLENILKVGEAEKNLGTTGGVNLYAQAIDDAEGLEKIENLQSHDNTEIYEKAVKILETYWVEDEDETMPPGDASQTGFNFGGNGMPTVPSGGFNFS

SEQ ID NO: 8276 - protein, 532 aa, Cephalotaxus harringtonia
MSLRPVSRTEVRRKNYKVAVDADEARRKREDNMVEIRKNKREESLLKKRREGMQAQQFAPAVQSSAVEKKLESLPAMVAGVWSDDHALQLEATTQFRKLLSIERSPPIEEVIEAGVVPRFVEFLMRQDFPQLQFEAAWALTNIASGTSEHTRVVIDHGAVPIFVQLLSSPSDDVREQAVWALGNVAGDSPKCRDLVLTHGALMPLLAQLNEHAKLSMLRNATWTLSNFCRGKPQPAFEQTKPALPALERLIHSNDEEVLTDACWALSYLSDGTNDKIQAVIEAGVCRRLVELLLHPSPSVLIPALRTVGNIVTGDDVQTQYIINNQALPCLLALLTHNHKKSIKKEACWTISNITAGNKEQIQAVIDANIIPPLVQLLQTAEFDIKKEAAWAISNATSGGTHEQIKYLVNQGCIKPLCDLLVCPDPRIITVCLEGLENILKVGEAEKDLGNTGGVNLYAQYIDDAEGLEKIENLQSHDNNEIYEKAVKILETYWLEDEEDDQALPAGGDVSQPTFNFGANQPAVPSGGFNFG

SEQ ID NO: 8277 - protein, 530 aa, Medicago truncatula
MSLRPNARTEVRRNRYKVAVDADEGRRRREDNMVEIRKSKREESLLKKRREGLQNQPQFTPLQSSSIVEKKLESLPAMVAGVWSDDNNQQLEATTQFRKLLSIERSPPIEEVIQSGVVPRFVQFLVREDFPQLQFEAAWALTNIASGTSENTKVVIDHGAVPIFVKLLSSPSDDVREQAVWALGNVAGDSPRCRDLVLSHGALIPLLTQLNEQAKLSMLRNATWTLSNFCRGKPQPPFDQVRPALPALERLVFSNDEEVLTDACWALSYLSDGTNDKIQAVIEAGVCGRLVQLLLHPSPSVLIPALRTVGNIVTGDDAQTQAIIGHGSLPCLLSLLTHNHKKSIKKEACWTISNITAGNKEQIQAVIEAGLIAPLVNLLQNAEFDIKKEAAWALSNATSGGTHEQIKYLVSQGCIKPLCDLLVCPDPRIVTVCLEGLENILKIGEAEKSFGNAGDVNLYAQMIDEAEGLEKIENLQSHDNNEIYEKAVKILETYWLEDEDETLPPGDGSQPGFNFGGNDLPVPSGGFNFG

SEQ ID NO: 8278 - protein, 533 aa, Trifolium pratense
MSYRPNANSRTEVRRNRYKVAVDAEEGRRRREDTMVEIRKNRREESLMKKRREGLPPQQIPSSLHSTVVEKKLENLPSMVASAWSDDNNLQLEATTQFRKLLSIERTPPIEEVIQTGVVSRFVEFLMREDFPQLQFEAAWALTNIASGTSENTKVVIDHGAVPIFVKLLASSSDDVREQAVWALGNVAGDSPRCRDLVLGHGALVPLLAQLNEHAKLSMLRNATWTLSNFCRGKPQPPFDQVKPALPALAGLIHSNDEEVLTDACWALSYLSDGTNDKIQAVIEAGVCPRLVELLLHPSPSVLIPALRTVGNIVTGDDQQTQVIINHQSLPCLFNLLTNNYKKSIKKEACWTISNITAGNKQQIQAVIEGNIFGPLVNLLQNAEFDIKKEAAWAISNATSGGSHEQIKYLVSQGCIKPLCDLLICPDPRIVTVCLEGLENILKVGEADKNIGNTGDVNLYAQMIDDAEGLEKIENLQSHDNTEIYEKAVKILETYWLEEEDETMPPGEAAQSGFNFGGAEVPSVPSGGFNFNQ

SEQ ID NO: 8279 - protein, 531 aa, Ambrosia trifida
MSLRPSDRTDLRRNRYKVAVDADEGRRRREDNMVEIRKNRREESLQKKRREGLAANQFPVPVQSASVGEKKLENLPAMVAGLYSDDSSMQLEATTQFRKLLSIERSPPIEEVIKTGVVPRFVQFLMREEYAQLQFESAWALTNIASGTSEHTKVVIDHGAVPIFVKLLASSSDDVREQAVWALGNVAGDSPKCRDLVLAEGALQSLLLLLNANAKLSMLRNATWTLSNFCRGKPQPAFEQTKPALPALQQLIHSNDEEVLTDACWALSYLSDGTNDKIQAVIESNVCPRLVELLNHPSPTVLIPALRTVGNIVTGDDMQTQYIIDHQALPCLLNLLTNNHKKSIKKEACWTISNITAGNKEQIQTVIAANLIGPLVQLLQSAEFDIKKEAAWAISNATSGGSHDQIKYLVSQGCIKPLCDLLVCPDPRIVTVCLEGLENILKVGESEKNLGRSGDTNLYAQMIDDAEGLEKIENLQSHDNNEIYEKAVKLLETYWVEEEDDDVMPPGEIAQPGFNFGGGDVAVPNGGFNFN

SEQ ID NO: 8280 - protein, 529 aa, Cucumis melo
MSLRPNERAEVRRNRYKVAVDADEGRRRREDNMVEIRKNRREESLQKKRREGLQAQQLQTSTHSSAVEKKLEHLPSMVAGVWSDDGSLQLESTTQFRKLLSIERSPPIEEVIQAGVVPRFVEFLMREDFPQLQFEAAWALTNIASGTSENTKVVIDHGAVPIFVKLLGSPSDDVREQAVWALGNVAGDSSRCRDLVLGHGALLPLLAQLNEQAKLSMLRNATWTLSNFCRGKPQPAFDLVKPALPALARLIHSNDEEVLTDACWALSYLSDGTNDKIQAVIEAGVCPRLVELLMHPAPSVLIPALRTVGNIVTGDDLQTQVIIQHNALPCLLNLLTNNHKKSIKKEACWTISNITAGNKAQIQAVIDANIVAPLVHLLQNAEFDIKKEAAWAISNATSGGSHDQIKYLVNQGCIKPLCDLLICPDPRIVTVCLEGLENILKVGEAEKNTTDTGGVNLYAQLIDDAEGLEKIENLQSHDNTEIYEKAVKILETYWLEEEDETMPPGTAPQGGFNFGGDRPVVPSGGFNFG

SEQ ID NO: 8281 - protein, 345 aa, Cajanus cajan
MSLRPNARTEVRRNRYKVAVDADEGRRRREDNLVEIRKSKREESLLKKRREGLQQFPAPLQNSTVDKKLESLPAMVTGVWSDDNSLQLEATTQFRKLLSIERSPPIEEVIQAGVVPRFVEFLVREDFPQLQFEAAWALTNIASGTSENTKVVIDHGAVPIFVKLLSSPSDDVREQAVWALGNVAGDSPRCRDLVLSNGALIPLLAQLNEHAKLSMLRNATWTLSNFCRGKPQPPFEQVRPALPALERLVFSNDEEVLTDACWALSYLSDGTNDKIQAVIEAGVCGRLVQLLIHPSPSVLIPALRTVGNIVTGDDMQTQSIINHGALPCLLNLLTHNHKKSIKKEA

SEQ ID NO: 8282 - protein, 530 aa, Amsonia hubrichtii
MSLRPSERTEVRRNRYKVAVDAEEGRRRREDHMVEIRKNKREENLLKKRREGLQMSQPFPTTVPANNIEKKLESLPSMVAGVWSNDSNLQLEATTQFRKLLSIERSPPIEEVIQSGVVPRFVEFLMRQDFPQLQFEAAWALTNIASGTSENTKVVIDQGAVPIFVKLLGSPSDDVREQAVWALGNVAGDSPRCRDLVLSHGALIPLLAQLNEHAKLSMLRNATWTLSNFCRGKPQPPFEQVRPALPALQRLVHSNDEEVLTDACWALSYLSDGTNDKIQAVIEAGVCHRLVELLLHPSPSVLIPALRTVGNIVTGDDLQTQCIIDQGALTCLLSLLTHNHKKSIKKEACWTISNITAGNKEQIQAVIDAQLIGPLVNLLQTAEFDIKKEAAWAISNATSGGTHDQIKYLVSQGCIKPLCDLLVCPDPRIVTVCLEGLENILKVGEVEKGLGNTGDVNYYAQLIDEAEGLEKIENLQSHDNNEIYEKAVKILETYWLEEEDETLPAGNGAQPGFNFGGNDVQLPSGGFKFG

SEQ ID NO: 8283 - protein, 530 aa, Eucalyptus grandis
MSLRPNARTEVRRNRYKVAVDADEGRRRREDNMVEIRKSRREESLLKKRREGLQAPQASPSLHSSAVEKKLENLPSMVAAVLSNDKSLQVDATTQFRKLLSIERSPPIEEVIQSGVVPRFVEFLMKEDFPQLQFEAAWALTNIASGTSENTKVVIDHGAVPIFVKLLRSPSDDVREQAVWALGNVAGDSPKCRDLVLLNGALLPLLAQLNEHAKLSMLRNATWTLSNFCRGKPQPLFEQVKPALPALAHLIHSTDEEVLTDACWALSYLSDGTNDKIQAVIEAGVCPRLVELLLHPSPSVLIPALRTVGNIVTGDDLQTQCVIEHQALPCLLNLLTGNYKKSIKKEACWTISNITAGNKEQIQAVVEADIIGPMVQLLQNAEFDIKKEAAWAISNATSGGSHEQIKFLVNQGCVKPLCDLLICPDPRIVTVCLEGLENILKVGEAEKNLGNTGDVNVYAQMVEDVEGLEKIESLQSHDNNEIYEKAVKILEAYWLEEDDDAMPPGDAPQPDMQFGGNNLPPMPSGGFKFG

SEQ ID NO: 8284 - protein, 533 aa, Trigonella foenum-graecum
MSYRPNANSRTEVRRNRYKVAVDAEEGRRRREDTMVEIRKNRREESLLKKRREGLQPQQIPSALHSNVVEKKLEHLPTMVAGVWSDDNNLQLESTTQFRKLLSIERTPPIEEVIQTGVVSRFVEFLMREDFPQLQFEAAWALTNIASGTSENTKVVIDHGAVPIFVKLLASSSDDVREQAVWALGNVAGDSPRCRDLVLGHGALIPLLGQLNEHAKLSMLRNATWTLSNFCRGKPQPPFDQVKPALPALAGLIHSNDEEVLTDACWALSYLSDGTNDKIQAVIEAGVCPRLVELLLHPSPSVLIPALRTVGNIVTGDDVQTQVIINHQALPCLYSLLTNNYKKSIKKEACWTISNITAGNKQQIQSVIEANIFGPLVNLLQNAEFDIKKEAAWAISNATSGGSHEQIKYLVNQGCIKPLCDLLICPDPRIVTVCLEGLENILKVGEADKNIGNTGDVNQYAQMIDDAEGLEKIENLQSHDNTEIYEKAVKILETYWLEEEDETMPPGDASQSGFNFGSAEVPSVPSGGFNFNQ

SEQ ID NO: 8285 - protein, 530 aa, Cucumis sativus
MSLRPTARTEVRRNRYKVSVDAEEGRRRREDNMVEIRKSKREESLQKKRREGLQAQQFPSAVHTSTVEKKLESLPSMVAGVWSDNSSLQLEATTQFRKLLSIERSPPIEEVIQSGVVPRFVEFLVREDFPQLQFEAAWALTNIASGTSEHTKVVIDHGAVPIFVKLLASPSDDVREQAVWALGNVAGDSPTCRDLVLRHGALIPLLSQLNEHAKLSMLRNATWTLSNFCRGKPQPPFDQVKPALPALERLVHSNDEEVLTDACWALSYLSDGTNDKIQAVIEAGVCGRLVQLLLHPSPSVLIPALRTVGNIVTGDDIQTQWIVNDGALSCLLGIFTQNHKKSIKKEACWTISNITAGNKEQIQAVIEARLIPPLVNLLQNAEFDIKKEAAWAISNATSGGTHEQIKYLVSQGCIKPLCDLLVCPDPRIVTVCLEGLENILKVGEAEKNLGTNGDVNLYAQMIDDAEGLEKIENLQSHDNHEIYEKAVKILETYWLEEEDEALPATDGGAQPGFRFGGNELPVPSGGFNFS

SEQ ID NO: 8286 - protein, 531 aa, Cicer arietinum
MSLRPNARTEVRRNRYKVAVDADEGRRRREDNMVEIRKSKREESLLKKRREGLQAQPQFPTSVQSSSIVERKLESLPAMIAGVWSDDNSQQLEATTQFRKLLSIERSPPIEEVIQSGVVPRFVEFLVREDFPQLQFEAAWALTNIASGTSENTKVVIDHGAVPIFVKLLSSPSDDVREQAVWALGNVAGDSPRCRDLVLSHGALIPLLSQLNEHAKLSMLRNATWTLSNFCRGKPQPPFEQVRPALPALERLVFSNDEEVLTDACWALSYLSDGTNDKIQAVIEAGVCGRLVQLLLHPSPSVLIPALRTVGNIVTGDDLQTQAIINHGSLPCLLSLLTHNHKKSIKKEACWTISNITAGNKEQIQAVIEAGLIAPLVNLLQNAEFDIKKEAAWAISNATSGGTHEQIKYLVSQGCIKPLCDLLVCPDPRIVTVCLEGLENILKVGEAEKSFGNTGDVNLYAQMIDDAEGLEKIENLQSHDNNEIYEKAVKILETYWLEDEDETLPAGDGSQPGFNFGSSDLPVPSGGFNFS

SEQ ID NO: 8287 - protein, 529 aa, Unknown
  Sequence found in Organisms: Gossypium hirsutum, Gossypium raimondii
MSLRPNSRTEVRRNRYKVAVDAEEGRRRREDNMVEIRKNRREESLQKKRREGLQAQPMPASLHSSAVEKKLENLPAMVAGVWADDSNMQLEATTQFRKLLSIERSPPIDQVIQAGVVPRFIEFLARDDFPQLQFEAAWALTNIASGTSENTKVVIDHGAVPIFVKLLASPSDDVREQAVWALGNVAGDSPRCRDLVLSHGALLPLLAQLNEHAKLSMLRNATWTLSNFCRGKPQPPFDLVKPALPALTHLIHSNDEEVLTDACWALSYLSDGTNDKIQAVIEAGVCGRLVELLMHPCPSVLIPALRTVGNIVTGDDGQTQCIINHQALPCLLNLLTNNFKKSIKKEACWTISNITAGNKEQIQAVIEANIISPLVHLLQNAEFDIKKEAAWAISNATSGGTHDQIKFLVSQGCIKPLCDLLNCPDPRIVTVCLEGLENILKVGEADKNLGTTGGVNLYAQMIDDAEGLEKIENLQSHDNTEIYEKAVKVLETYWLEEEDETMPPGDASQTGFHFGGGELPVPSGGFSFS

SEQ ID NO: 8288 - protein, 534 aa, Gossypium raimondii
MSLRPSARTEVRRNRYKVAVDAEEGRRRREDNMVEIRKNKREENLLKKRREGLLAQQQQPQQQQLLSSTAGSEKKLESLPAMVAGVWSDDRNMQLEATTQFRKLLSIERSPPINEVVQSGVVPRFVEFLNRDDFPQLQFEAAWALTNIASGTSDNTRVVIDHGAVPIFVKLLGSPTDDVREQAVWALGNVAGDSPKCRDLVLGHGALVPLLAQFNEHAKLSMLRNATWTLSNFCRGKPQPSFEQTKPALPALERLIHSNDEEVLTDACWALSYLSDGTNDKIQAVIEAGVCPRLVELLMHPSPTVLIPALRTVGNIVTGDDMQTQCIIGHQALPCLLNLLTNTYKKSIKKEACWTISNITAGNVDQIQAVIEAGIIAPLVHLLQNAEFEIKKEAAWAISNATSGGTHEQIKFLVSQGCIKPLCDLLNCPDPRIVTVCLEGLENILKVGEAEKNLGHTGDVNLYAQLIDDAEGLEKIENLQSHDNNEIYEKAVKILETYWVEDEDEALPTGDASQPGFQFGGNQLPVPSGGFNFS

SEQ ID NO: 8289 - protein, 532 aa, Cichorium intybus
MSLRPSARTEVRRNRYKVAVDADEGRRRREDNMVEIRKNKREENLLKKRQVVPSSQPLSTGVPIQTATIEKKLESLPSMVAGVYSNDNTMQLEATTQFRKLLSIERSPPIEEVIQSGVVPRFVEFLMREDFPQLQFEAAWALTNIASGTSENTKVVIDHGAVPIFVKLLASPSDDVREQAVWALGNVAGDSPRCRDLVLGQGALIPLLAQLNEHAKLSMLRNATWTLSNFCRGKPQPPFELTKPALPALERLVHSNDEEVLTDACWALSYLSDGTNDKIQAVIEAGVCQRLVELLLHPSPSVLIPALRTVGNIVTGDDLQTQCIIEHGALPYLLNLLTHNHKKSIKKEACWTISNITAGNKEQIQAVIEAGLIAPLVNLLQTAEFDIKKEAAWAISNATSGGNNEQIKYLVSQGCIKPLCDLLACPDPRIVTVCLEGLENILKVGEVEKNSGQSGDVNLYAQLIDEAEGLEKIENLQSHDNNEIYEKAVKILETYWLEEEDEVVGDAAQPQPGFNFGGNNVQLPSGGFNFNN

SEQ ID NO: 8290 - protein, 534 aa, Gossypium hirsutum
MSLRPSARTEVRRNRYKVAVDAEEGRRRREDNMVEIRKNKREENLLKKRREGLFAQQQQPQQQQLLSSTAGSEKKLESLPAMVAGVWSDDRNMQLEATTQFRKLLSIERSPPINEVVQSGVVPRFVELLNRDDFPQLQFEAAWALTNIASGTSDNTRVVIDHGAVPIFVKLLGSPTDDVREQAVWALGNVAGDSPKCRDLVLGHGALVPLLAQFNEHAKLSMLRNATWTLSNFCRGKPQPSFEQTKPALPALERLIHSNDEEVLTDACWALSYLSDGTNDKIQAVIEAGVCPRLVELLMHPSPTVLIPALRTVGNIVTGDDMQTQCIIGHQALPCLLNLLTNTYKKSIKKEACWTISNITAGNVDQIQAVIEAGIIAPLVHLLQNAEFEIKKEAAWAISNATSGGTHEQIKFLVSQGCIKPLCDLLNCPDPRIVTVCLEGLENILKVGEAEKNLGHTGDVNLYAQLIDDAEGLEKIENLQSHDNNEIYEKAVKILETYWVEDEDEALPTGDASQPGFQFGGNQLPVPSGGFNFS

SEQ ID NO: 8291 - protein, 531 aa, Lotus japonicus
MSLRPNARTEIRRNRYKVAVDADEGRRRREDNMVEIRKSKREESLQKKRREGLQAQQQFATPLQSSSIVEKKLESLPAMVAGVWSDDNSQQLEATTQFRKLLSIERSPPIEEVIQSGVVPRFVEFLVREDFPQLQFEAAWALTNIASGTSENTKVVIDHGAVPIFVKLLSSPSDDVREQAVWALGNVAGDSPRCRDLVLSHGALIPLLSQLNEHAKLSMLRNATWTLSNFCRGKPQPPFEQVRPALPALERLVFSNDEEVLTDACWALSYLSDGTNDKIQAVIEAGVCSRLVQLLLHPSPSVLIPALRTVGNIVTGDDMQTQAIINHGSLPCLLSLLTQNHKKSIKKEACWTISNITAGNKEQIQSVIEAGLIAPLVNLLQNAEFDIKKEAAWAISNATSGGTHEQIKYLVSQGCIKPLCDLLVCPDPRIVTVCLEGLENILKVGEADKNLGNSGDVNLYAQLIDEAEGLEKIENLQSHDNNEIYEKAVKILETYWLEDEDETLPPGEGAQPGFNFGTNELPVPSGGFNFS

SEQ ID NO: 8292 - protein, 529 aa, Capsicum annuum
MSLRPSARTEVRRNRYKVAVDAEEGRRRREDNMVEIRKSKREESLLKKRREGLQAQQQQFPSNLQTSTVEKKLASLPSMVAGVWSTDNNLQLEANTQFRKLLSIERSPPIEEVIQSGVVPRFVEFLLREDFPQLQFEAAWALTNIASGTSENTRVVIDHGAVPIFVKLLGSPSDDVREQAVWALGNVAGDSPRCRDLVLSNGALIPLLAQLNEHAKLSMLRNATWTLSNFCRGKPQPPFEQVRPALSALQRLVHSTDEEVLTDACWALSYLSDGTNDKIQAVIEAGVCPRLVELLVHPSPSVLIPALRTVGNIVTGDDLQTQCIIEHGALPCLLSLLTHNHKKSIKKEACWTISNITAGNKEQIQAVIAAGLISPLVNLLQSAEFDIKKEAAWAISNATSGGTHEQIKFLVSQNCIKPLCDLLVCPDPRIVTVCLEGLENILKVGEAEKANTGGINYYAQLTDDAEGLEKIENLQSHDNNEIYEKAVKILETYWLEEEDETLPAGDGTQNEFNFGGNDIQLPSGGFQFG

SEQ ID NO: 8293 - protein, 529 aa, Populus trichocarpa
MSLRPSTRTDVRRNRYKVAVDADEGRRRREDNMVEIRKNKREESLQKKRREGLLAQQFPAAVLSSSNMEKKLESLPSMVSGVWSDDSNLQLEATTQFRKLLSIERSPPIEEVIQAGVVPRFVELLVREDFPQLQFEAAWALTNIASGTSENTKVVIDHGAVPIFVKLLGSPSDDVREQAVWALGNVAGDSPKCRDLVLSHGALIPLLAQLNEHAKLSMLRNATWTLSNFCRGKPQPLFEKVRPALPALERLVHSTDEEVLTDACWALSYLSDGTNDKIQAVIEAGVCPRLVELLLHPSPSVLVPALRTVGNIVTGDDMQTQCIINTGALPCLLSLLTHNHKKSIKKEACWTISNITAGNKEQIQAVIEAGLIGPLVNLLQNAEFDIKKEAAWAVSNATSGGTHEQIKFLVSQGCIKPLCDLLVCPDPRIVTVCLEGLENILKVGEAEKNLGNSGDVNFYAQMIDDAEGLEKIENLQSHDNNEIYEKAVKILETYWLEEDDEALPSGDGAQQGFHFGENNVQVPSGGFNF

SEQ ID NO: 8294 - protein, 529 aa, Cucumis sativus
MSLRPNERAEVRRNRYKVAVDADEGRRRREDNMVEIRKNRREESLQKKRREGLQAQQLQTSTHSSVVEKKLEYLPSMVAGIWSDDGSLQLESTTQFRKLLSIERSPPIEEVIQAGVVPRFVEFLMREDFPQLQFEAAWALTNIASGTSENTKVVIDHGAVPIFVKLLGSPSDDVREQAVWALGNVAGDSSRCRDLVLGHGALVPLLAQLNEQAKLSMLRNATWTLSNFCRGKPQPAFDLVKPALPALARLIHSNDEEVLTDACWALSYLSDGTNDKIQAVIEAGVCPRLVELLMHPAPSVLIPALRTVGNIVTGDDLQTQVIIQHNALPCLLNLLTNNHKKSIKKEACWTISNITAGNKAQIQAVIDANIVAPLVHLLQNAEFDIKKEAAWAISNATSGGSHDQIKYLVNQGCIKPLCDLLICPDPRIVTVCLEGLENILKVGEAEKNTTNTGGVNLYAQLIDDAEGLEKIENLQSHDNTEIYEKAVKILETYWLEEEDETMPPGTDPQAGFNFGGDRPVVPSGGFNFG

SEQ ID NO: 8295 - protein, 509 aa, Taxus baccata
MVAGVWSDDPALQLEATTQFRKLLSIERSPPIEEVIEAGVVPRFVEFLTRQDFPQLQFEAAWALTNIASGTSEHTRVVIDHGAVPIFVQLLSSPSDDVREQAVWALGNVAGDSPKCRDLVLTHGALMPLLAQLNEHAKLSMLRNATWTLSNFCRGKPQPAFEQTKPALPALERLIHSNDEEVLTDACWALSYLSDGTNDKIQAVIEAGVCRRLVELLLHPSPSVLIPALRTVGNIVTGDDVQTQYIINNQALPCLLALLTHNHKKSIKKEACWTISNITAGNKEQIQAVIDANIIPPLVQLLQTAEFDIKKEAAWAISNATSGGTHEQIKYLVNQGCIKPLCDLLVCPDPRIITVCLEGLENILKVGEAEKDLGNTSGVNLYAQYIDDAEGLEKIENLQSHDNNEIYEKAVKILETYWLEDEEDDQALPASGDARPPSIQFRYKSTISAIWWIPVWLRRYLSCCKLGGYVMSVLNDFPRLCICAVVRHCKDNAWFLDGAGDRPIVGMSV

SEQ ID NO: 8296 - protein, 530 aa, Catharanthus roseus
MSLRPNERTEVRRNRYKVAVDAEEGRRRREDQMVEIRKSKREENLLKKRREGLQMSQPFPTTLPASNVEKKLESLPSMVAGVWSNDSNLQLEATTQFRKLLSIERSPPIEEVIQSGVVPRFVEFLMREDVPNLQFEAAWALTNIASGTSENTKVVIDHGAVPIFVKLLQSPSDDVREQAVWALGNVAGDSPRCRDLVLSHGALIPLLSQLNEHAKLPMLRNATWTLSNFCRGKPQPPFEQVRPALPALQRLVHSNDGEVLTDACWALSYLSDGTNDKIQAVIEAGVCDRLVELLLHPSPSVLIPALRTVGNIVTGDDVQTQCIIDQGALTCLLSLLTHNHKKSIKKEACWTISNITAGNKEQIQAVIDAQLIGPLVNLLQTAEFDIKKEAAWAISNATSGGTHDQIKYLVSQGCIKPLCDLLVCPDPRIVTVCLEGLENILKVGEAEKNLGNTGDVNYFAQLIDEAEGLEKIENLQSHDNNEIYEKAVKILETYWLEEEDAVLPPGDGAQPGFNFGGNDVQLPSGGFKFG

SEQ ID NO: 8297 - protein, 532 aa, Eschscholzia californica
MSLRPNARTEVRRNRYKVAVDADEGRRRREDNMVEIRKNKREESLQKKRREGMQPQQFSSSIQGNNVVEKKLESLPSMVAGVWSDEKELQLEATTQFRKLLSIERSPPIEEVIQSGVVPRFVEFLMREDYPQLQFEAAWALTNIASGTSENTKVVIDHGAVPIFVKLLGSPSDDVREQAVWALGNVAGDSPKCRDYVLEQGALMPLLAQLNEHAKLSMLRNATWTLSNFCRGKPQPLFEQTKPALPALQGLIHSNDEEVLTDACWALSYLSDGTNDKIQAVIESGVCPRLVELLLHPSPSVLIPALRTVGNIVTGDDIQTQFIINHQALPCLLNLLTNNHKKSIKKEACWTISNITAGNKDQIQTVIAAGIIGPLIHLLQTAEFDIKKEAAWAISNATSGGAHEQIKYMVDQGCIKPLCDLLICPDPRIVTVCLEGLENILKVGEAEKNLGNSEGVNIYAQLIDDAEGLEKIENLQSHDNTEIYEKAVKILETYWLEEDDEQLPPGDDASAQSGFQFGGNQPPVPSGGFNFS

SEQ ID NO: 8298 - protein, 529 aa, Euonymus alatus
MSLRPNARTEVRRNRYKVAVDVEEGRRRREDNMVEIRKNRREESLQKKRREGLQTQQIPASINSSAVEKKLENLPAMVAGVWSDDKNLQLEATTQFRKLLSIERSPPIVEVIQAGVVPRFVEFLMREDYPQLQFEAAWVLTNIASGTSENTKVVIDHGAVPIFVKLLASPSDDVREQAVWALGNIAGDSPRCRDLVLGHGALLPLLSQLNEHAKLSMLRNATWTLSNFCRGKPQPPFDQVKPALPALARLIHSNDEEVLTDACWALSYLSDGTNDKIQAVIEAGVCPRLVELLTHPSPSVLVPALRTVGNIVTGDDLQTQCIINHQALPCLLTLLTNNYKKSIKKEACWTISNITAGNKEQIQSVIEAVIIGPLVHLLQNAEFDIKKEAAWAISNATSGGTRDQIKLLVSQGCIKPLCDLLICPDPRIVTVCLEGLENILKAGEADKNLGDTGGVNLYAQLIDDAEGLEKIENLQSHDNTEIYEKSVKILETYWLEEEDETMPHGDAPQGFQFGGGEVPTVPSGGFNFS

SEQ ID NO: 8299 - protein, 532 aa, Unknown
  Sequence found in Organisms: Pinus pinaster, Pinus taeda
MSLRPMSRTEVRKKTYKVAVDADEARRKREDNMVEIRKSKREESLQKKRREGMQAQQFAPTVQSSAVEKKLESLPAMVAGVWSDEPNLQLEATTQFRKLLSIERSPPIEEVIDAGVVPRFVEFLTRHDFPQLQFEAAWALTNIASGTSEHTRVVIDRGAVPIFVQLLSSPSDDVREQAVWALGNVAGDSPKCRDLVLSHGALMPLLAQLNEHAKLSMLRNATWTLSNFCRGKPQPAFDQTKPALPALERLIHSNDEEVLTDACWALSYLSDGTNDKIQAVIEAGVCRRLVELLLHPSPSVLIPALRTVGNIVTGDDVQTQYIINNQALPCLLALLTHNHKKSIKKEACWTISNITAGNKDQIQAVIDANIIPPLVQLLQTAEFDIKKEAAWAISNATSGGTHDQIKYLVNQGCIKPLCDLLVCPDPRIVTVCLEGLENILKVGEAEKDLGNTGGVNLYAQYIDDAEGLEKIENLQSHDNNEIYEKAVKILETYWLEDDEDDQTLPATGDAAQPTFNFGANQPTVPSGGFTFG

SEQ ID NO: 8300 - protein, 528 aa, Fragaria vesca
MSLRPNARTEVRRNRYKVAVDAEEGRRRREDNMVEIRKSKREESLLKKRREGLQAQQFPASVQPANLEKRLESLPSMVAGVWSTDSALQLESTTQFRKLLSIERSPPIEEVIQAGVVPRFVEFLVREDYPQLQFEAAWALTNIASGTSDNTKVVIEHGAVPIFVKLLASPSDDVREQAVWALGNVAGDSPRCRDLVLSSGALMPLLAQLNEHAKLSMLRNATWTLSNFCRGKPQPQFDQVKPALPALERLVHSNDEEVLTDACWALSYLSDGTNDKIQAVIEAGVCPRLVQLLLHPSPAVLIPALRTVGNIVTGDDLQTQCIITNGALPCLLSLLTHNHKKSIKKEACWTISNITAGNREQIQHVIEAGLIGPLVNLLQTAEFEIKKEAAWAISNATSGGTHEQIKVLVTEGCIKPLSDLLVCPDPRIVTVCLEGLENILKVGEAEKNLGNSGTNLYAQLIDEADGLEKIENLQTHDNNEIYEKAVKILETYWLEDEDETLPAGDAAQPGFNFGGNGPQVPTGGFNFS

SEQ ID NO: 8301 - protein, 532 aa, Glycine max
MSYRPSANARTEVRRNRYKVAVDADEGRRRREDTMVEIRKSRREESLQKKRREGLQSQQIPSSLHSTVIEKKLEHLPAMVTGVFTDDNNMQLEATTQFRKLLSIERSPPIEEVIQAGVVPRFVDFLMREDFPQLQFEAAWALTNIASGTSENTKVIIDHGAVPIFVKLLGSPSDDVREQAVWALGNVAGDSPRCRDLVLGHGALLPLLAQLNEHAKLSMLRNATWTLSNFCRGKPQPAFDQVKPALPALASLIQSNDEEVLTDACWALSYLSDGTNDKIQGVIEAGVCSRLVDLLLHPSPSVLIPALRTVGNIVTGDDLQTQVIINHQALPRLLNILTNNYKKSIKKEACWTISNITAGNKKQIQDVIEASIIAPLVHLLQNAEFDIKKEAAWAISNATSGGSHEQIKFLVSQGCIRPLCDLLICPDPRIVTVCLEGLENILKVGEAEKNVSNTDGVNLYAQMIDDAEGLEKIENLQSHDNTEIYEKAVKILETYWMEEDDETMPPGDASQSGFNFGGTQPPAVPSGGFDFN

SEQ ID NO: 8302 - protein, 532 aa, Glycine max
MSYRPSANARTEVRRNRYKVAVDADEGRRRREDTMVEIRKNRREESLLKKRREGLQSQQIPSSLHSTVIEKKLEHLPAMVTGVFTDDNNMQFEATTQFRKLLSIERSPPIEEVIQAGVVPRFVEFLMREDFPQLQFEAAWALTNIASGTSENTKVVIDHGAVPIFVKLLGSPNDDVREQAVWALGNVAGDSPRCRDLVLGDGALLPLLAQLNEHAKLSMLRNATWTLSNFCRGKPQPAFDQVKPALPALASLIQSTDEEVLTDACWALSYLSDGTNDKIQGVIEAGVCSRLVELLLHPSPSVLIPALRTVGNIVTGDDLQTEVIINHQALSRLLNLLTNNYKKSIKKEACWTISNITAGNKKQIQDVIEASIIAPLVHLLQNAEFDIKKEAAWAISNATSGGSHEQIKFLVSQGCIKPLCDLLICPDPRIVTVCLEGLENILKVGEAEKNVSNTDGVNLYAQMIDDAEGLEKIENLQSHDNTEIYEKAVKILETYWMEEDDETMPPGDASQSGFNFGGAQPPAVPSGGFNFN

SEQ ID NO: 8303 - protein, 532 aa, Phaseolus coccineus
MSYRPSGNSRTDVRRNRYKVAVDAEEGRRRREDTMVEIRKNRREESLQKKRREGLQPQQIPASVHSTLVEKKLEHLPSMVAGVWTEDNNLQLEATTQFRKLLSIERSPPIEEVIQTGVVSRFVEFLMREDFPQLQFEAAWALTNIASGTSENTKVVIDHGAVPIFVKLLASPSDDVREQAVWALGNVAGDSPRCRDLVLGHGALIPLLAQLNEQAKLSMLRNATWTLSNFCRGKPQPPFDQVKPALPALARLIHSNDEEVLTDACWALSYLSDGTNDKIQAVIEAGVCPRLVELLMHPSPSVLIPALRTVGNIVTGDDMQTQVIINHQALACLLNLLTNNYKKSIKKEACWTISNITAGNKQQIQSVIEANLITPLVNLLQNAEFDIKKEAAWAISNATSGGSHEQIKFLVSQGCIKPLCDLLICPDPRIVTVCLEGLENILKVGEADKSIGNTGDVNLYAQIIDDAEGLEKIENLQSHDNTEIYEKAVKILETYWLEEDDETMPPGDASQSGFNFGNNDAPAVPSGGFNFN

SEQ ID NO: 8304 - protein, 532 aa, Podocarpus macrophillus
MSLRPISRTEVRKKSYKVAVDADEARRKREDNMVEIRKNKREESLLKKRREGMQAQQFTPQVQSSAVEKKLESLPAMVGGVWSDDPSLQLEATTQFRKLLSIERSPPIEEVIEAGVVPRFVEFLTRQDFPQLQFEAAWALTNIASGTSDHTRVVIDHGAVPIFVQLLSSPSDDVREQAVWALGNVAGDSPKCRDLVLSHGALMPLLAQLNEHAKLSMLRNATWTLSNFCRGKPQPAFEQTKPALPALERLIHSNDEEVLTDACWALSYLSDGTNDKIQAVIEAGVCRRLVELLLHPSPSVLIPALRTVGNIVTGDDVQTQYIINNQALPCLLALLTHNHKKSIKKEACWTISNITAGNKDQIQAVIDANIIPPLVQLLQTAEFDIKKEAAWAISNATSGGTHEQIKYLVNQGCIKPLCDLLVCPDPRIITVCLEGLENILKVGEAEKDLGNSGGVNLYAQYIDDAEGLEKIENLQSHDNNEIYEKAVKILETYWLEDEEDDQALPAGGDVAQPAFNFGSNQPSVPSGGFNFG

SEQ ID NO: 8305 - protein, 533 aa, Picea glauca
  misc_feature (207)..(207): Xaa can be any naturally occurring amino acid
MSLRPMSRTEVRKKTYKVAVDADEARRKREDNMVEIRKSKREESLQKKRREGMQAQQFAPTVQSSAVEKKLESLPAMVAGVWSDEPNLQLEATTQFRKLLSIERSPPIEEVIDAGVVPRFVEFLTRHDFPQLQFEAAWALTNIASGTSEHTRVVIDRGAVPIFVQLLSSPSDDVREQAVWALGNVAGDSPKCRDLVLSHGALMPLLXQLNEHAKLSMLRNATWTLSNFCRGKPQPAFEQTKPALPALERLIHSNDEEVLTDACWALSYLSDGTNDKIQAVIEAGVCRRLVELLLHPSPSVLIPALRTVGNIVTGDDVQTQYIINNQALPCLLALLTHNHKKSIKKEACWTISNITAGNKDQIQAVIDANIIPPLVQLLQTAEFDIKKEAAWAISNATSGGTHEQIKYLVNQGCIKPLCDLLVCPDPRIVTVCLEGLENILKVGEAEKDLGNTGGVNLYAQFIDDAEGLEKIENLQSHDNNEIYEKAVKILETYWLEDDEDDQTLPATGDAAAQPTFNFGTNQPTVPSGGFTFG

SEQ ID NO: 8306 - protein, 534 aa, Gossypium raimondii
MSLRPSARTEVRRNRYKVAVGAEEGRRRREDNMVEIRKNKREENLLKKRREGLLAQQPQPQQQQMLSSGVGSENKLESLPAMVVGVWSDDKNAQLEATTQFRKLLSIERSPPINEVVQAGVVPRFVEFLNRDDFPQLQFEAAWALTNIASGTSDNTRVVIDHGAVPIFVKLLGSPTDDVREQAVWALGNVAGDSPKCRDLVLGHGALVPLLAQFNEHAKLSMLRNATWTLSNFCRGKPQPSFEQTKPALPALERLINSNDEEVLTDACWALSYLSDGTNDKIQAVIEAGVCPRLIELLLHPSPTVLIPALRTVGNIVTGDDMQTQCIIGHQALPCLLNLLTNTYKKSIKKEACWTISNITAGNVDQIQAVIEAGIIAPLVHLLQNAEFEIKKEAAWAISNATSGGTHEQIKFLVSQGCIKPLCDLLNCPDPRIVTVCLEGLENILKVGEAEKNLGHTGDVNLYAQLIDDAEGLEKIENLQSHDNNEIYEKAVKILETYWVEDEDEPLPPGDAAQSGLQFGGNQLPVPSGGFNFN

SEQ ID NO: 8307 - protein, 534 aa, Gossypium hirsutum
MSLRPSARTEVRRNRYKVAVDAEEGRRRREDNMVEIRKNKREENLLKKRREGLLAQQQQPQQQQLLSSTAGSEKKLESLPAMVAGVWSDDRNMQLEATTQFRKLLSIERSPPINEVVQSGVVPRFVEFLNRDDFPQLQFEAAWALTNIASGTSDNTRVVIDHGAVPIFVKLLGSPTDDVREQAVWALGNVAGDSPKCRDLVLGHGALVPLLAQFNEHAKLSMLRNATWTLSNFCRGKPQPSFEQTKPALPALERLIHSNDEEVLTDACWALSYLSDGTNDKIQAVIESGVCPRLVELLMHPSPTVLIPALRTVGNIVTGDDMQTQCIIGHQALPCLLNLLTNTYKKSIKKEACWTISNITAGNVDQIQAVIEAGIIAPLVHLLQNAEFEIKKEAAWAISNATSGGTHEQIKFLVSQGCIKPLCDLLNCPDPRIVTVCLEGLENILKVGEAEKNLGHTGDVNLYAQLIDDAEGLEKIENLQSHDNNEIYEKAVKILETYWVEDEDEALPTGDASQPGFQFGGNQLPVPSGGFNFS

SEQ ID NO: 8308 - protein, 534 aa, Gossypium hirsutum
MSLRPSARTEVRRNRYKVAVDAEEGRRRREDNMVEIRKNKREENLLKKRREGLLAQQPQPQQQQMLSSGVGSENKLESLPAMVVGVWSDDKNAQLEATTQFRKLLSIERSPPINEVVQAGVVPRFVEFLNRDDFPQLQFEAAWALTNIASGTSDNTRVVIDHGAVPIFVKLLGSPTDDVREQAVWALGNVAGDSPKCRDLVLGHGGLVPLLAQFNEHAKLSMLRNATWTLSNFCRGKPQPSFEQTKPALPALERLINSNDEEVLTDACWALSYLSDGTNDKIQAVIEAGVCPRLIELLLHPSPTVLIPALRTVGNIVTGDDMQTQCIIGHQALPCLLNLLTNTYKKSIKKEACWTISNITAGNVDQIQAVIEAGIIAPLVHLLQNAEFEIKKEAAWAISNATSGGTHEQIKFLVSQGCIKPLCDLLNCPDPRIVTVCLEGLENILKVGEAEKNLGHTGDVNLYAQLIDDAEGLEKIENLQSHDNNEIYEKAVKILETYWVEDEDEPLPPGDAAQSGLQFGGNQLPVPSGGFNFN

SEQ ID NO: 8309 - protein, 289 aa, Arachis hypogaea
MSLRPSERTEVRRNRYKVAVDADEGRRRREDNMVEIRKSKREESLLKKRREGLQAQQLLQQQQQFPTNVQASSIMEKKLESLPAMVAGVLSNDNSQQLEATTQFRKLLSIERSPPIEEVIQAGVVPRFVEFLHRDDFPQLQFEAAWALTNIASGTSENTKVVIDHGAVPIFVKLLGSPSDDVREQAVWALGNVAGDSPRCRDLVLSHGALIPLLAQLNEHAKLSMLRNATWTLSNFCRGKPQPPFEHVKPALPTLERLVFSNDEEVLTDACWALSYLSDGTNDKIQAVY

SEQ ID NO: 8310 - protein, 530 aa, Phalaenopsis aphrodite
MSLRPSARAEVRRNKYKVAVDAEEGRRRREDNMVEIRKSKREENLQKKRREGMQVQPFPTSIQSSTVEKKLESLPAMISGVCSEDSSLQLEATTQFRKLLSIERSPPIEEVIQSGVVPRFVEFLTRDDFPQLQFEAAWALTNIASGTSDNTKVVIDHGAVPIFVRLLRSPSDDVREQAVWALGNVAGDSPKCRDLVLANGALMPLLAQLNDHAKLSMLRNATWTLSNFCRGKPQPNFEQTKPALPALKHLIHSTDEEVLTDACWALSYLSDGTNDKIQSVIEAEVVPRLVELLYHPSPSVLIPALRTVGNIVTGDDIQTQYVIGNGALPFLLNLLTQSYKKSIKKEACWTISNITAGNKEQIQAVIEANIIGPLVDLLQNAEFDIKKEAAWAISNATSGGTHDQIKFLVTQGCIKPLCDLLVCPDPRIVTVCLEGLENILKVGEAEKNLGTTGGVNLYAQMIDEAEGLDKIENLQSHDNTEIYEKAVKILETYWLEEEDEAMPTGDSAQTGFNFGANEQYSVPSGGFKFG

SEQ ID NO: 8311 - protein, 528 aa, Rosa hybrid cultivar
MSLRPNARTEVRRNRYKVAVDAEEGRRRREDNMVEIRKSKREESLLKKRREGLQAQQFPASVQPPNLEKKLESLPSMVAGVWSSESALQLEATTQFRKLLSIERSPPIEEVIQAGVVPRFVEFLVREDYPQLQFEAAWALTNIASGTSDNTRVVIDHGAVPIFVKLLASPSDDVREQAVWALGNVAGDSPRCRDLVLSSGALMPLLAQLNEHAKLSMLRNATWTLSNFCRGKPQPQFDQVKPALPALERLVHSNDEEVLTDACWALSYLSDGTNDKIQAVIEAGVCPRLVQLLLHPSPAVLIPALRTVGNIVTGDDLQTQCIITNGALPCLLSLLTHNHKKSIKKEACWTISNITAGNREQIQYVIEAGLIGPLVNLLQTAEFEIKKEAAWAISNATSGGTHEQIKILVTEGCIKPLSDLLVCPDPRIVTVCLEGLENILKVGEAEKSLGNSGTNLYAQLIDEADGLEKIENLQTHDNNEIYEKAVKILETYWLEDEDETLPAGDGTQPGFNFGGNGPQVPTGGFNFS

SEQ ID NO: 8312 - protein, 534 aa, Quercus alba
MSLRPNERTEVRRNRYKVAVDADEGRRRREDNMVEIRKSKREESLQKKRREGLQATHQQSFSSSLHASATTTVEKKLESLPSMVSGVWSTDNNLQLEATTQFRKLLSIERSPPIEEVIQSGVVPRFVEFLVREDFPQLQFEAAWALTNIASGTSENTKVVIDHGAVPIFVKLLGSPSDDVREQAVWALGNVAGDSPRCRDLVLGHGALIPLLGQLNEHAKLSMLRNATWTLSNFCRGKPQPSFDQVKPALPALERLVHSNDEEVLTDACWALSYLSDGTNDKIQAVIEAGVCARLVQLLLHPSPSVLIPALRTVGNIVTGDDIQTQCIINHGALQCLLSLLTHNHKKSIKKEACWTISNITAGNREQIQAVIEAGLIGPLVNLLQNAEFDIKKEAAWAISNATSGGTHEQLKYLVSQGCIKPLCDLLVCPDARIVTVCLEGLENILRVGEAEKSLGNSGEVNLYAQMIDDAEGLEKIENLQSHDNNEIYEKAVKILETYWMEEDDSLPPADGSQPGFGFGGNEVQVPSGGFNFS

SEQ ID NO: 8313 - protein, 532 aa, Pseudotsuga menziesii
MSLRPMSRTEVRKKTYKVAVDADEARRKREDNMVEIRKSKREESLQKKRREGMQAQQFAPAVQSSAVEKKLESLPAMVAGVWSDEPNLQLEATTQFRKLLSIERSPPIEEVIDAGVVPRFVEFLTRHDFPQLQFEAAWALTNIASGTSEHTRVVIDRGAVPIFVQLLSSPSDDVREQAVWALGNVAGDSPKCRDLVLSHGALMPLLAQLNEHAKLSMLRNATWTLSNFCRGKPQPAFEQTKPALPALERLIHSNDEEVLTDACWALSYLSDGTNDKIQAVIEAGVCRRLVELLLHPSPSVLIPALRTVGNIVTGDDVQTQYIINNQALPCLLALLTHNHKKSIKKEACWTISNITAGNKDQIQAVIDANIIPPLVQLLQSAEFDIKKEAAWAISNATSGGTHEQIKYLVNQGCIKPLCDLLVCPDPRIVTVCLEGLENILKVGEAEKDLGNTGGVNLYAQFIDDAEGLEKIENLQSHDNNEIYEKAVKILETYWLEDDEDDQTLPATGDAAQQTFNFGTNQPTVPSGGFTFG

SEQ ID NO: 8314 - protein, 359 aa, Phaseolus coccineus
MSLRPNARTEVRRNRYKVAVDADEGRRRREDNMVEIRKSKREESLQKKRREGLQAQQQFPAPLQASTVDKKLESLPAMVAGVWSDDNNLQLEATTQFRKLLSIERSPPIEEVIQAGVVPRFVEFLVREDFPQLQFEAAWALTNIASGTSENTKVVIDHGAVPIFVKLLSSPSDDVREQAVWALGNVAGDSPRCRDLVLSHGALVPLLAQLNEHAKLSMLRNATWTLSNFCRGKPQPPFEQVRPALPALERLIFSNDEEVLTDACWALSYLSDGPNDKIQAVIEARVCPTLVQLLLNQSPSVLIPALRTVGNIVTGDDMQTQSIINHGALPCLLNLLNHNHKKKHQERSLLDYIKYYCWK

SEQ ID NO: 8315 - protein, 444 aa, Gossypium hirsutum
MSLRPSARTEVRRNRYKVAVDAEEGRRRREDNMVEIRKNKREENLLKKRREGLLAQQQQPQQQQLLSSTAGSEKKLESLPAMVAGVWSDDRNMQLEATTQFRKLLSIERSPPINEVVQSGVVPRFVEFLNRDDFPQLQFEAAWALTNIASGTSDNTRVVIDHGAVPIFVKLLGSPTDDVREQAVWALGNVAGDSPKCRDLVLGHGALVPLLAQFNEHAKLSMLRNATWTLSNFCRGKPQPSFEQTKPALPALERLIHSNDEEVLTDACWALSYLSDGTNDKIQAVIESGVCPRLVELLMHPSPTVLIPALRTVGNIVTGDDMQTQCIIGHQALPCLLNLLTNTYKKSIKKEACWTISNITAGNVDQIQAVIEAGIIAPLVHLLQNAEFEIKKEAAWAISNATSGGTHEQIKFLVSQGCIKPLCDLLNCPDPRIVTVCLEGLETF

SEQ ID NO: 8316 - protein, 529 aa, Unknown
  Sequence found in Organisms: Solanum tuberosum, Solanum phureja
MSLRPSDRTEVRRNRYKVAVDADEGRRRREDNLVEIRKSKREESLLKKRREGLQAQQQQFPANLQTSTVEKKLESLPSMVAGVWSNDNNMQLEATTQFRKLLSIERSPPIEEVIQSGVVPRFVEFLMREDFPQLQFEAAWALTNIASGTSENTRVVIDHGAVPIFVKLLASPSDDVREQAVWALGNVAGDSPRCRDLVLSNGALIPLLSQLNEHAKLSMLRNATWTLSNFCRGKPQPPFEQVRPALSALQRLVHSNDEEVLTDACWALSYLSDGTNDKIQAVIEAGVCPRLVELLMHPSPSVLIPALRTVGNIVTGDDLQTQCIIEHGALACLLSLLSHSHKKSIKKEACWTISNITAGNKEQIQAVVEAGLISPLVNLLQTAEFDIKKEAAWAISNATSGGSHEQIKFLVSQNCIKPLCDLLVCPDPRIVTVCLEGLENILKVGEAEKANTEGINYYAQLIDDAEGLEKIENLQSHDNNEIYEKAVKILETYWLEEEDETVPAGDGAQNEFNFGGNDIQLPSGGFKFG

SEQ ID NO: 8317 - protein, 530 aa, Solanum lycopersicum
MSLRPSDRTEVRRNRYKVAVDADEGRRRREDNLVEIRKSKREESLLKKRREGLQAAQQQQFPANLQTSTVEKKLESLPSMVAGVWSNDNNMQLEATTQFRKLLSIERSPPIEEVIQSGVVPRFVEFLMREDFPQLQFEAAWALTNIASGTSENTRVVIDHGAVPIFVKLLASPSDDVREQAVWALGNVAGDSPRCRDLVLSNGALIPLLSQLNEHAKLSMLRNATWTLSNFCRGKPQPPFEQVRPALSALQRLVHSNDEEVLTDACWALSYLSDGTNDKIQAVIEAGVCPRLVELLMHPSPSVLIPALRTVGNIVTGDDLQTQCIIEHGALACLLSLLSHSHKKSIKKEACWTISNITAGNKEQIQAVIEAGLISPLVNLLQTAEFDIKKEAAWAISNATSGGSHEQIKFLVSQNCIKPLCDLLVCPDPRIVTVCLEGLENILKVGEAEKANTEGINYYAQLIDDAEGLEKIENLQSHDNNEIYEKAVKILETYWLEEEDETVPAGDGAQNEFNFGGNDIQLPSGGFKFG

SEQ ID NO: 8318 - protein, 110 aa, Phaseolus coccineus
MSYRPSGNSRTDVRRNRYKVAVDAEEGRRRREDTMVEIRKNRREESLQKKRREGLQPQQIPASVHSTLVEKKLEHLPSMVAGVWTEDNNLQLEATTQFRKLLSIERSRSD

SEQ ID NO: 8319 - protein, 531 aa, Ambrosia trifida
MSLRPNARTEVRRNRYKVAVDADEGRRRREDNMVEIRKNKREENLLKKRQVLPAAQPLLSTGAPLPSSTIEKKLESLPSMVAGVYSNDNNMQLEATTQFRKLLSIERSPPIEEVIQSGVVPRFVEFLMREDYPQLQFEAAWALTNIASGTSENTKVVIDHGAVPIFVKLLGSQSDDVREQAVWALGNVAGDSPRCRDLVLGSGALRPLLAQLNEHAKLSMLRNATWTLSNFCRGKPQPPFEETKPALPALERLVHSNDEEVLTDACWALSYLSDGTNDKIQAVIEAGVCRRLVELLLHPSPSVLIPALRTVGNIVTGDDLQTQCIIEHGALPCLLSLLTNNHKKSIKKEACWTISNITAGNKEQIQAVIEAGLIAPLVHLLQTAEFDIKKEAAWAISNATSGGTNEQIKYLVNQGCIKPLCDLLVCPDPRIVTVSLEGLENILKVGEAEKNLGNTGDVNFYAQLIDDAEGLEKIENLQSHDNNEIYEKAVKILETYWLEEEEEPVVDGSQPGFNFGGPNAQVPPGGFNFNG

SEQ ID NO: 8320 - protein, 531 aa, Ricinus communis
MSLRPSARTEVRRNRYKVAVDADEGRRRREDNMVEIRKNKREENLQKKRREGLQAQQFPAAVNLTSSNMEKKLESLPAMVAGVWSDDKSLQLEATTQFRKLLSIERSPPIEEVIQSGVVPRFVEFLVREDFPQLQFEAAWALTNIASGTSENTRVVIDHGAVPIFVKLLASPSDDVREQAVWALGNVAGDSPKCRDLVLSNGALLPLLAQLNEHAKLSMLRNATWTLSNFCRGKPQPPFEQVRPALPALERLVHSTDDEVLTDACWALSYLSDGTNDKIQAVIEAGVCPRLVELLLHSSPSVLVPALRTVGNIVTGDDLQTQCIISNGALPYLLNLLAHNHKKSIKKEACWTISNITAGNKEQIQAVIESELIVPLVNLLQNAEFDIKKEAAWAISNATSGGTHEQIKYMVSQGCIKPLCDLLVCPDPRIVTVCLEGLENILKVGEAEKNLGNSGDVNLYAQLIDDAEGLEKIENLQSHDNNEIYEKAVKVLETYWLEEDDETLPPGDNSQQGFHFGGNDPSAPAGGFNFS

SEQ ID NO: 8321 - protein, 529 aa, Malus domestica
MSLRPSARTEVRRNRYKVAVDAEEGRRRREDNMVEIRKSKREESLLKKRREGLQPQQFASSLQPSNLEKKLESLPAMVAGVWSDDNNLQLESTTQFRKLLSIERSPPIEEVIQSGVVPRFVAFLIREDFPQLQFEAAWALTNIASGTSENTKVVIEQGAVPIFVKLLASPSDDVREQAVWALGNVAGDSPRCRDLVLGSGALMPLLAQLNEHAKLSMLRNATWTLSNFCRGKPQPPFDQVKPALPALERLVHSNDEEVLTDACWALSYLSDGTNDKIQAVIEAGVCVRLVQLLLHPSPSVLIPALRTVGNIVTGDDLQTQCIINNGSLPCLLSLLTHNHKKSIKKEACWTISNITAGNRDQIQSVIEAGLIGPLVNLLQHAEFDIKKEAAWAISNATSGGTADQIKYLVGEGCIKPLCDLLVCPDPRIVTVCLEGLENILKVGEAEKAAGNSGEVNLYAQLIDDAEGLEKIENLQSHDNTEIYEKSVKILETYWLEEDEETLPAGDGTQQGIRFEGNEVQVPSGGFNFS

SEQ ID NO: 8322 - protein, 530 aa, Arnica chamissonis
MSLRPSARTEVRRNRYKVAVDADEGRRRREDNMVEIRKNKREESLLKKRQVLPASQPLSTGAPVPTSTVEKKLESLPSMVAGVYSNDNNMQLEATTQFRKLLSIERSPPIEEVIQSGVVPRFVEFLMREDFPQLQFEAAWALTNIASGTSENTKVVIDHGAVPIFVKLLASPSDDVREQAVWALGNVAGDSPRCRDLVLGQGALRPLLAQLNEHAKLSMLRNATWTLSNFCRGKPQPPFEETRPALPALERLVHSNDEEVLTDACWALSYLSDGTNDKIQAVIEAGVCRRLVELLLHPSPSVLIPALRTVGNIVTGDDLQTQCIIEHGALPCLLSLLTNNHKKSIKKEACWTISNITAGNKEQIQSVIAAGLIAPLVNLLQTAEFDIKKEAAWAISNATSGGTNEQIKFLVSQGCIKPLCDLLVCPDPRIVTVSLEGLENILKVGEAEKNLGNSGEVNIYAQMIDDAEGLEKIENLQSHDNNEIYEKAVKILETYWLEEEEEPVVDGSQPGFNFGGPNVQVPPGGFNFNG

SEQ ID NO: 8323 - protein, 526 aa, Beta vulgaris
MSLRPNARTEVRRNRYKVTVDADEGRRRREDNMVEIRKSKREESLLKKRREGLQVQQPFAPPLHTSTVEKKLESLPNMVAGVCSDNNQMQLEATTQFRKLLSIERSPPIEEVIEAGVVPRFVEFLQREDYPQLQFEAAWALTNIASGTSENTKVVIDHGAVPIFVKLLASPSDDVREQAVWALGNVAGDSPRCRDLVLSSGALIPLLAQLNEHSKLSMLRNATWTLSNFCRGKPQPPFDQVKPALPALERLVHSNDEEVLTDACWALSYLSDGPNDKIQTVIEAGVCPRLVELLMHPAPSVLIPALRTVGNIVTGDDVQTQFIISNGALPCLLNLLTLNHKKSIKKEACWTISNITAGNKEQIQAVVEAGLIGPLVNLLQTAEFDIKKEAAWAISNATSGGSQEQIKYLVNQGCIKPLCDLLVCPDPRIITVCLEGLENILKVGEAEKSLGSTGDVNYYAQLIDEAEGLEKIENLQSHDNNEIYEKAVKILETYWLEEEEETVPSGDQAGFQMWSNEGPSGGFKFG

SEQ ID NO: 8324 - protein, 532 aa, Cedrus atlantica
MSLRPMSRTEVRKKTYKVAVDADEARRKREDNMVEIRKNKREESLQKKRREGMQAQQFAPTVQSSAVEKKLESLPAMVAGVWSDEPNLQLEATTQFRKLLSIERSPPIEEVIDAGVVPRFVEFLTRHDFPQLQFEAAWALTNIASGTSEHTRVVIERGAVPIFVQLLSSPSDDVREQAVWALGNVAGDSPKCRDLVLSHGALMPLLSQLNEHAKLSMLRNATWTLSNFCRGKPQPSFEQTKPALPALERLIHSNDEEVLTDACWALSYLSDGTNDKIQAVIEAGVCRRLVELLLHPSPSVLIPALRTVGNIVTGDDVQTQYIINNQALPCLLALLTHNHKKSIKKEACWTISNITAGNKDQIQAVIDANIIPPLVQLLQTAEFDIKKEAAWAISNATSGGTHEQIKYLVNQGCIKPLCDLLVCPDPRIVTVCLEGLENILKVGEGEKDLGNSGGVNLYAQFIDDAEGLEKIENLQSHDNNEIYEKAVKILETYWLEDDEDDQTLPATGDAAQPAFNFGTNQPTVPSGGFTFG

SEQ ID NO: 8325 - protein, 530 aa, Flaveria ramosissima
MSLRPNARTEVRRNRYKVAVDADEGRRRREDNMVEIRKNKREENLLKKRQVLSSSQPVATGAPVPTSTIEKKLESLPSMVAGVYSNDNNMQLEATTQFRKLLSIERSPPIEEVIQSGVVPRFVEFLMREDFPQLQFEAAWALTNIASGTSENTKVVIDHGAVPIFVKLLASPSDDVREQAVWALGNVAGDSPRCRDLVLGQGALLPLLAQLNEHAKLSMLRNATWTLSNFCRGKPQPPFEETKPALPALERLVHSNDEEVLTDACWALSYLSDGTNDKIQAVIEAGVCRRLVELLLHPSPSVLIPALRTVGNIVTGDDLQTQCIIEHGALPCLLNLLTNNHKKSIKKEACWTISNITAGNKEQIQAVIEAGLIAPLVNLLQTAEFDIKKEAAWAISNATSGGTNEQIKFLVSQGCIKPLCDLLVCPDPRIVTVSLEGLENILKVGEAEKNLGNTGDVNYYAQLIDDAEGLEKIENLQSHDNNEIYEKAVKILETYWLEEEEEAVVDGSQPGYNFGGPNVQVPPGGFNFNG

SEQ ID NO: 8326 - protein, 529 aa, Lippia dulcis
MSLRPSARTEVRRSRYKVAVDAEEGRRRREDNMVEIRKNRREENLLKKRREGLQAQQFQPTVNVPQLDKKLESLPAMVVGVWSNDGALQLEATTQFRKLLSIERNPPIEEVIQSGVVPRFVEFLARDDYPQLQFEAAWALTNIASGTSDNTKVVIDHGAVPIFVRLLSSASDDVREQAVWALGNVAGDSPKCRDLVLGYGALMPLLAQFNDQAKLSMLRNATWTLSNFCRGKPQPQFEQVKPALPALAHLIHTNDEEVLTDACWALSYLSDGVNDKIQAVIETGVCPRLVELLMHPSPSVLIPALRTVGNIVTGDDVQTQVIIENRSLPCLLSLLTQNYKKSIKKEACWTISNITAGNKDQIQAVIEAGIISPLVNLLQNAEFEIKKEAAWAISNATSGGTHDQIKVLVREGCIKPLCDLLVCPDPRIVTVCLEGLENILKVGEVDKTQGNTGDVNVFAQMIDDAEGLEKIENLQSHDNNEIYEKAVKILETYWLEEDDEQLVSAEAPQSGFNFGGGDLPVPSGGFKFS

SEQ ID NO: 8327 - protein, 530 aa, Helianthus annuus
MSLRPNARTEVRRNRYKVAVDADEGRRRREDNMVEIRKNKREENLLKKRQVLPSAQPLATGAPVPVSTIEKKLESLPSMVAGVYSTDNNMQLEATTQFRKLLSIERSPPIEEVIQSGVVPRFVEFLMREDFPQLQFEAAWALTNIASGTSENTKVVIDHGAVPIFVKLLASPSDDVREQAVWALGNVAGDSPRCRDLVLGQGALRPLLAQLNEHAKLSMLRNATWTLSNFCRGKPQPPFEETKPALPALERLVHSNDEEVLTDACWALSYLSDGTNDKIQAVIEAGVCRRLVELLLHPSPSVLIPALRTVGNIVTGDDMQTQCIIEHGALPCLLSLLTNNHKKSIKKEACWTISNITAGNKEQIQSVIEAGLIAPLVHLLQTAEFDIKKEAAWAISNATSGGTNEQIKYLVNQGCIKPLCDLLVCPDPRIVTVSLEGLENILKVGEAEKNLGNTGDVNYYAQLIDDAEGLEKIENLQSHDNNEIYEKAVKILETYWLEEEDEPVVDGSQPAFNFGGPTAQVPPGGFNFNG

SEQ ID NO: 8328 - protein, 534 aa, Theobroma cacao
MSLRPSARTEVRRNRYKVAVDAEEGRRRREDNMVEIRKNKREENLLKKRREGLLAQQQQPQQQQLLSSTAASEKKLESLPAMVAGVWSEDRNAQLEATTQFRKLLSIERSPPINEVVQSGVVPRFVEFLARDDFPQLQFEAAWALTNIASGTSENTRVVIDHGAVPIFVKLLGSPTDDVREQAVWALGNVAGDSPKCRDLVLGHGALVPLLAQFNEHAKLSMLRNATWTLSNFCRGKPQPSFEQTKPALPALERLIHSNDEEVLTDACWALSYLSDGTNDKIQAVIEAGVCPRLVELLLHPSPTVLIPALRTVGNIVTGDDVQTQCIINHQALPCLLNLLTNNYKKSIKKEACWTISNITAGNVDQIQAVIEAGIIAPLVHLLQNAEFEIKKEAAWAISNATSGGTHEQIKFLVSQGCIKPLCDLLNCPDPRIVTVCLEGLENILKVGEAEKNLGHTGEVNLYAQLIDDAEGLEKIENLQSHDNNEIYEKAVKILETYWVEDEDEPLPPGDASQSGFQFGANQHPVPSGGFNFS

SEQ ID NO: 8329 - protein, 525 aa, Castanea mollissima
MSLRPNARTEVRRNRYKVAVDAEEGRRRREDNMVEIRKNRREESLQKKRREGLVAPQMPSTPTSEKKLESLPAMVAGVCSDDMNLQLEATTQFRKLLSIERSPPINEVVQSGVVPRFVEFLARDEFPQLQFEAAWALTNIASGTSENTRVVIDHGAIPIFVKLLGSPADDVREQAVWALGNVAGDSPKCRDLVLSHGALMPLLLQFNEHAKLSMLRNATWTLSNFCRGKPPPPFEQTKPAIPALERLIQSNDEEVLTDACWALSYLSDGTNDKIQAVIDAGVCPRLVELLLHPSPTVLIPALRTVGNIVTGDDMQTQCMINHQALPCLLNLLTHNHKKSIKKEACWTISNITAGNVNQIQAVIEAGIIPPLVQLLQIAEFEIKKEAAWAISNATSGGTHDQIKYLVSQGCIKPLCDLLICPDPRIVTVCLEGLENILKVGEAEKNMGKTDVNLNAQLIDDAEGIDKIENLQSHDNNEIYEKAVKILETYWVEDDDEPLPPGDAPQSSFNFGGNEVPVPSGGFNFS

SEQ ID NO: 8330 - protein, 409 aa, Taraxacum officinale
MSLRPNARTEVRRNRYKVAVDAEEGRRRREDNMVEIRKNKREENLLKKRQVVPSSQPLSTGAPIQTATTEKKLESLPSMVAGVYSNDNNMQLEATTQFRKLLSIERSPPIEEVIQSGVVPRFVEFLMREDFPQLQFEAAWALTNIASGTSENTKVVIDHGAVPIFVKLLASPSDDVREQAVWALGNIAGDSPKCRDLVLGQGALVPLLAQLNEHAKLSMLRNATWTLSNFCRGKPQPPFEPTKPALPALERLVHSNDEEVLTDACWALSYLSDGTNDKIQAVIQAGVCQRLVELLLHPSPSVLIPALRTVGNIVTGDDLQTQCIIEHGALPYLLSLLTHNHKKSIKKEACWTISNITAGNKEQIQAVIIAGLISPLVNLLQQPNSTSKKKQHGPYQTPLPVATMNKSST

SEQ ID NO: 8331 - protein, 533 aa, Lactuca sativa
MSLRPSARTEVRRNRYKVAVDAEEGRRRREDNMVEIRKNRREESLQKKRREVTAGQFAMPVQSASAAEKKLENLPAMVAGVLSNDNNMQLEATTQFRKLLSIERSPPIEEVIQSGVVPRFVEFLVREDFPQLQFEAAWALTNIASGTSEHTKVVIDHGAVPIFVKLLASPSDDVREQAVWALGNVAGDSPKCRDLVLGQGALISLLSQLNAHAKLSMLRNATWTLSNFCRGKPQPSFDQTKPALPALQQLIRSEDDEVLTDACWALSYLSDGTNDKIQAVIEANVCPRLVELLNRASPSVLIPALRTVGNIVTGDDMQTQYIINLQALPCLLNLLNGNHKKSIKKEACWTISNITAGNKEQIQIVIEANIIGPLVLLLQTAEFDIKKEAAWAISNATSGGTHDQIKYLVSEGCIKPLCDLLICPDPRIVTVCLEGLENILKVGEAEKNLGQSGDVNVYAQMIDDAEGLEKIENLQSHDNNEIYEKAVKLLETYWLDEEDDVMPPGEATPQPQAAAFHFGGADVSVPSGGFTFN

SEQ ID NO: 8332 - protein, 498 aa, Arnica chamissonis
MVEIRKNKREENLLKKRQLLSSSQPLSTGVSVQTSTVEKKLESLPSMVAGVYSTDNNLQLEATTQFRKLLSIERSPPIEEVIQSGVVPRFVEFLMREDFPQLQFEAAWALTNIASGTSENTKVVIDHGSVPIFVKLLASPSDDVREQAVWALGNVAGDSPRCRDLVLGHGALIPLLSQLNEHAKLSMLRNATWTLSNFCRGKPQPPFEQTRPALPALERLIHSNDEEVLTDACWALSYLSDGTNDKIQAVIDAGVCQRLVELLLHPSPSVLIPALRTVGNIVTGDDLQTQHIIERGALPCLLSLLTHNHKKSIKKEACWTISNITAGNKEQIQTVIEAGLIAPLVNLLQTAEFDIKKEAAWAISNATSGGTNEQIKYLVIQGCIKPLCDLLVCPDPRIVTVSLEGLENILKVGEVEKQAGNTGDVNLYAQLIDDAEGLEKIENLQSHDNNEIYEKAVKILETYWLDEEDENLADGAQATFDFGGNNVQVPSGGFNFNS

SEQ ID NO: 8333 - protein, 529 aa, Populus trichocarpa
MSLRPSARTEVRRNRYKVAVDADEGRRRREDNMVEIRKNKREESLLKKRREGLQAQQFPPAILSSSNVEKKLENLPSMVAGVWSEDGNLQLESTTQFRKLLSIERSPPIEEVIQAGVVPRFVEFLVREDFPQLQFEAAWALTNIASGTSENTKVVIDHGAVPIFVKLLGSPSDDVREQAVWALGNVAGDSPKCRDLVLSHGALIPLLAQLNEHAKLSMLRNATWTLSNFCRGKPQPPFEQVRPALPALERLVHSTDEEVLTDSCWALSYLSDGTDDKIQAVIEAGVCPRLVELLLHPSPSVLVPALRTVGNIVTGDDMQTQCIITTGALPCLLSLLTHNHKKSIKKEACWTISNITAGNKEQIQAVIENGLIGPLVNLLQNAEFDIKKEAAWAVSNATSGGTHEQIKFLVSQGCIKPLCDLLVSPDPRIVTVSLEGLENILKVGEAEKNLGNSGDANFYAQMIDDAEGLEKIENLQSHDNNEIYEKAVKILETYWLEEDDETLPSGDGAQQGFQFGGNGVQVPSGGFNF

SEQ ID NO: 8334 - protein, 532 aa, Helianthus annuus
MSLRPNARTEVRRNRYKVAVDADEGRRRREDNMVEIRKNKREENLLKKRQVLPSAQPVSAGAPVTTSATVEKKLESLPSMVAGVYSTDNNLQLEATTQFRKLLSIERSPPIEEVIQSGVVPRFVEFLMREDFPQLQFEAAWALTNIASGTSENTKVVIDHGAVPIFVKLLASPSDDVREQAVWALGNVAGDSPRCRDLVLGQGALLPLLAQLNEHAKLSMLRNATWTLSNFCRGKPQPPFEETKPALPALERLVHSNDEEVLTDACWALSYLSDGTNDKIQAVIEAGVCRRLVELLLHPSPSVLIPALRTVGNIVTGDDLQTQCIIEHGALPCLLSLLTNNHKKSIKKEACWTISNITAGNKEQIQSVIEAGLIAPLVNLLQNAEFDVKKEAAWAISNATSGGTNEQIKYLVSQGCIKPLSDLLVCPDPRIVTVSLEGLENILKVGEAEKNLGNTGDVNYFAQLIDDAEGLEKIENLQSHDNNEIYEKAVKILETYWLEEEEEELVVDGAQAGFNFGGPNAQVPPGGFNFNG

SEQ ID NO: 8335 - protein, 532 aa, Helianthus annuus
MSLRPNARTEVRRNRYKVAVDADEGRRRREDNMVEIRKNKREENLLKKRQVLPSAQPASAGAPVNTSATVEKKLESLPSMVAGVYSTDNNLQLEATTQFRKLLSIERSPPIEEVIQSGVVPRFVEFLMREDFPQLQFEAAWALTNIASGTSENTKVVIDHGAVPIFVKLLASPSDDVREQAVWALGNVAGDSPRCRDLVLGQGALLPLLAQLNEHAKLSMLRNATWTLSNFCRGKPQPPFEETKPALPALERLVHSNDEEVLTDACWALSYLSDGTNDKIQAVIEAGVCRRLVELLLHPSPSVLIPALRTVGNIVTGDDLQTQCIIEHGALPCLLSLLTNNHKKSIKKEACWTISNITAGNKEQIQSVIEAGLIAPLVNLLQNAEFDVKKEAAWAISNATSGGTNEQIKYLVSQGCIKPLSDLLVCPDPRIVTVSLEGLENILKVGEAEKNLGNTGDVNYFAQLIDDAEGLEKIENLQSHDNNEIYEKAVKILETYWLEEEEEELVVDGAQAGFNFGGPNAQVPPGGFNFNG

SEQ ID NO: 8336 - protein, 71 aa, Flaveria ramosissima
MSLRPSERTDARRNRYKVAVDADEGRQRREDNMVEIRKNRREESLQKKRREGLAASQFPLPVQSASAAEKS

SEQ ID NO: 8337 - protein, 532 aa, Abies balsamea
MSLRPMSRTEVRKKTYKVAVDADEARRKREDNMVEIRKNKREESLQKKRREGMQAQQFPPTVQSTAVEKKLESLPAMVAGVWSDEPTLQLEATTQFRKLLSIERSPPIEEVIDAGVVPRFVDFLTRHDFPQLQFEAAWALTNIASGTSEHTRVVIERGAVPIFVQLLSSPSDDVREQAVWALGNVAGDSPKCRDLVLSHGALPPLLAQLNEHAKLSMLRNATWTLSNFCRGKPQPAFEQTKPALPALERLIHSNDEEVLTDACWALSYLSDGTNDKIQAVIEAGVCRRLVELLLHPSPSVLIPALRTVGNIVTGDDVQTQYIINNQALPCLLALLTHNHKKSIKKEACWTISNITAGNKDQIQAVIDANIIPPLVQLLQTAEFDIKKEAAWAISNATSGGTHEQIKYLVNQGCIKPLCDLLVCPDPRIVTVCLEGLENILKVGEAEKDLGNTGGVNLYAQFIDDAEGLEKIENLQSHDNNEIYEKAVKILETYWLEDDEDDQALPATGEAAQPAFNFGSNQPTVPSGGFTFG

SEQ ID NO: 8338 - protein, 527 aa, Amborella trichopoda
MSLRPNSRAEVRKKNYKVAVDADEARRKREDNMVEIRKSKREESLQKKRREGMQAQFAPTVQPSAMDKKLESLPNMVAKIYSEDSAMQLEATTQFRKLLSIERSPPIEEVIEAGVVPRFVQFLTRQDFPQLQFEAAWALTNIASGTSDNTKVVIDQGAVPIFVQLLSSPSDDVREQAVWALGNVAGDSPKCRDLVLSQGALMPLLAQLNEHAKLSMLRNATWTLSNFCRGKPQPPFEQTRPALPALERLIHSTDEEVLTDACWALSYLSDGTNDKIQAVIEAGVCRRLVELLMHPSPSVLIPALRTVGNIVTGDDVQTQYIINNQALPCLLTLLTHNHKKSIKKEACWTISNITAGNKEQIQAVIDANIIPPLVQLLQTAEFDIKKEAAWAISNATSGGTHEQIKYLVNQGCIRPLCDLLVCPDPRIVTVCLEGLENILKVGEAEKNLGNTDGVNLYAQLIDDAEGLDKIENLQSHDNNEIYEKAVKILETYWLEEDEDTLLPPGETAPAAFTFGSNQPPIGGFNFS

SEQ ID NO: 8339 - protein, 531 aa, Cirsium arvense
MSLRPSARTEVRRNRYKVAVDAEEGRRRREDNMVEIRKNKREENLLKKRQVVPSSQPLSSGAPVQTSTIEKKLESLPSMVAGVYSNDSNMQLEATTQFRKLLSIERSPPIEEVIQSGVVPRFVEFLMREDFPQLQFEAAWALTNIASGTSDNTKVVIDHGAVPIFVKLLASPSDDVREQAVWALGNVAGDSPRCRDLVLGQGALVPLLSQLNEQAKLSMLRNATWTLSNFCRGKPQPPFELTKPALPALERLVHSNDEEVLTDACWALSYLSDGTNDKIQAVIEAGVCQRLVELLLHPSPSVLIPALRTVGNIVTGDDVQTQCIIEHGALPCLLSLLTHNHKKSIKKEACWTISNITAGNKEQIQAVIEAGLITPLVNLLHTAEFDIKKEAAWAISNATSGGNNEQIKYLVSQGCIKPLCDLLACPDSRIVTVCLEGLENILKVGEVEKNLGHTGDVNYYAQLIDEAEGLEKIENLQSHDNNEIYEKAVKILETYWLEEEDEPVGDGAAQPGFNFGGGNVQVPSGGFNFNN

SEQ ID NO: 8340 - protein, 532 aa, Citrus sinensis
MSLRPNARAEVRRNRYKVAVDADEGRRRREDNMVEIRKNKREESLLKKRREGLQSQQFPPPAPASNLNLQTKLESLPAMVAGVWSDDSSLQLEATTQFRKLLSIERSPPIEEVIQSGVVPRFVEFLMREDYPQLQFEAAWALTNIASGTSENTKVVIDHGAVPIFVKLLASPSDDVREQAVWALGNVAGDSPRCRDLVLSQGALIPLLAQLNERAKLSMLRNATWTLSNFCRGKPQPPFDQVRPALPALAQLVHSNDEEVLTDACWALSYLSDGTNDKIQAVIEAGVCPRLVELLGHPSPSVLIPALRTVGNIVTGDDFQTQCIITYGALPYLLGLLTHNHKKSIKKEACWTISNITAGNRDQIQAVIDAGLVGPLVNLLQNAEFDIKKEAAWAISNATSGGTHEQIKYLVREGCIKPLCDLFVCPDPRIVTVCLEGLENILKVGEAEKNMGTATADVNQYAQLVEEAEGLEKIENLQSHDNNEIYEKAVKILETYWLEEDDETIAAGDGPQPGFPYAGNEVQVPSGGFNFS

SEQ ID NO: 8341 - protein, 543 aa, Quercus alba
MSLRPSARTEVRRNRYKVAVDAEEGRRRREDNMVEIRKSRREESLLKKRREGLQQLSSGAAQNQLQQPLLGSSFQSSATGLEKKLEHLPSMVAGVWSDDSNLQLEATTQFRKLLSIERSPPIEEVIQSGVVPRFVEFLMREDYPQLQFEAAWALTNIASGTSENTKVVIDHGAVPIFVKLLGSPSDDVREQAVWALGNVAGDSPRCRDLVLGNGALLPLLAQLNEHAKLSMLRNATWTLSNFCRGKPQPPFDQVKPALPALARLIHSNDEEVLTDACWALSYLSDGTNDKIQAVIEAGVCPRLVELLFHPSPSVLIPALRTVGNIVTGDDMQTQVIINHNALPCLLNLLNNNYKKSIKKEACWTISNITAGNKEQIQAVIAADIIAPLVNLLQNAEFDIRKEAAWAISNATSGGSPEQIKYLVNQGCIKPLCDLLICPDPRIVTVCLEGLENILKVGEADKNSGSSGDVNLYAQMIDDAEGLEKIENLQSHDNTEIYEKAVKILETYWLEEDDETMPGDAAQSTFNFGGSEVPSVPSGGFKFD

SEQ ID NO: 8342 - protein, 530 aa, Helianthus annuus
MSLRPSARTEVRRNRYKVAVDADEGRRRREDNMVEIRKNKREENLLKKRQLLSSSQSLAAGVPVQASTVEKKLESLPSMVAGVYSNDNNLQLEATTQFRKLLSIERSPPIEEVIQSGVVPRFVEFLMREDFPQLQFEAAWALTNIASGTSDNTKVVIEHGAVPIFVKLLASPSDDVREQAVWALGNVAGDSPRCRDLVLGHGALMPLLAQLNENAKLSMLRNATWTLSNFCRGKPQPPFEQTRPALPALQRLIHSNDEEVLTDACWALSYLSDGTNDKIQAVIDAGVCQRLVELLLHPSPSVLIPALRTVGNIVTGDDLQTQHIIECGALPCLLSLLTHNHKKSIKKEACWTISNITAGNKEQIQTVIEAGLIAPLVNLLQTAEFDIKKEAAWAISNATSGGTNEQIKYLVNQGCIKPLCDLLVCPDPRIVTVSLEGLENILKVGEVEKQVGNSGDVNFFAQLIDDADGLEKIENLQSHDNNEIYEKAVKILETYWLDEDDENVADGGQAGFDFGGNNVQVPSGGFNFNS

SEQ ID NO: 8343 - protein, 530 aa, Eschscholzia californica
MSLRPNARTEVRRNRYKVAVDADEGRRRREDNMVEIRKNKREESLMKKRREGMQPQQFPTSIQGTTAEKKLESLPSMVAGVWSEDRELQLEATTQFRKLLSIERSPPIEEVIQSGVVPRFVEFLMREDYPQLQFEAAWALTNIASGTSDNTKVVIDHGAVPIFVKLLGSPSDDVREQAVWALGNVAGDSPRCRDLVLREGALLPLLAQLNEHAKLSMLRNATWTLSNFCRGKPQPPFEQTRPALPALERLIHTNDEEVLTDACWALSYLSDGTNDKIQAVIEAGVCPRLVELLMHPSPTVLIPALRTVGNIVTGDDHQTQFVINHQALPCLVTLLTSNHKKSIKKEACWTISNITAGNKDQIQSVIDAGIISPLVHLLQTAEFDIKKEAAWAISNATSGGAHEQIKFLVDQGCIKPLCDLLICPDPRIVTVCLEGLENILKVGEAEKNLGNTDGVNIYAQLIDDAEGLEKIENLQSHDNTEIYEKAVKILETYWLEEDDEPLPPGDASAQTGFHFGGNEPPVPSGGFNFS

SEQ ID NO: 8344 - protein, 523 aa, Eucalyptus grandis
MSLRPSARAEVRRNRYKVAVDADEGRRRREDNLVEIRKSRREESLLKKRREGLPLAAPPQSTNLEKLESLPLMVAKVCSADAALQLEATTQFRKILSIERNPPIEEVIQSGVVPRFVEFLLREDFPQLQFEAAWALTNVASGTSENTKVVIDHGAVPIFVKLLASPSDDVREQAVWALGNVAGDSPKCRDLVLGHGALMHLLAQLNENAKLSMLRNATWTLSNFCRGKPQPSFELVKPGLPSLERLIHSNDEEVLTDACWALSYLSDGTNDKIQSVIEAGVCPRLIELLLHPSPSVLIPALRTVGNIVTGDDIQTQCIINNGVLPCLLSLLAHNHKKSIKKEACWTISNVTAGNSEQIQAVIEAGLIGPLLNLLQNAEFDIKKEAAWAISNATSGGSHDQIKYIVSQGCIKPLCDLLVCPDPRIVTVCLEALENILKIGQAEKECGNTGDNVYARMIDDAEGLEKIENLQSHDNNEIYEKAVKILETYWVEEEDEIVPPGDNTQPGFNFGGNGLPPSDGFNFN

SEQ ID NO: 8345 - protein, 529 aa, Vitis vinifera
MSLRPSARTEVRRNRYKVAVDAEEGRRRREDNLVEIRKNKREESLQKKRREGLQAQQFTTPVSASTFERKLESLPAMVAGVWSEDSNLQLEATTYFRKLLSIERSPPINEVIQSGVVPRLVEFLGRDDFPQLQFEAAWALTNIASGTSENTKVVIDHGAVPIFVKLLGSQNDDVREQAVWALGNVAGDSPKCRDLVLGHGALMPLMAQFNEHAKLSMLRNATWTLSNFCRGKPQPQFEQTKPALPALERLIHSNDEEVLTDACWALSYLSDGTNDKIQAVIEAGVCPRLVELLLHPSPSVLIPALRTVGNIVTGDDIQTQCIINYGALPCLLNLLSHNYKKSIKKEACWTISNITAGNKDQIQSVIEAGIIPPLIYLLQNAEFEIKKEAAWAISNATSGGTHDQIKLLVSQGCIKPLCDLLICPDPRIVTVCLEGLENILKVGEADKSLGHTDVNQFAQAIDDADGLEKIENLQSHDNTEIYEKAVKILETYWLEEDEEPLPPGDASQSEFHFGGNDHPPVPPGGFNFG

SEQ ID NO: 8346 - protein, 530 aa, Phalaenopsis aphrodite
MSLRPSARAEVRRSKYKVAVDAEEGRRRREDNMVEIRKSKREENLLKKRREGMQVPPFAASVLGSAVEKKLESLPAMVAGLYADDGASLLESTTQFRKLLSIERSPPIEEVIQTGVVPRFVEFLIRDDFPQLQFEAAWALTNIASGTSENTKVVIDHGAVPIFVKLLGSPSDDVREQAVWALGNVAGDSPKCRDLVLANGALMPLLSQLNGNAKLSMLRNATWTLSNFCRGKPQPNFEQTKPALPTLKHLIHSTDEEVLTDACWALSYLSDGTNDKIQAVIEAEVVPRLVELLLHPSPSVLIPALRTVGNIVTGDDVQTQYVISSGALQFLFNLLTQNLKKSIKKEACWTISNITAGSKEQIQAVIESNIIAPLVDLLQNAEFDIKKEAAWAISNATSGGTDDQIKFLVSQGCIKPLCDLLVCPDPRIATVCLEGLENILKVGEAEQNLGATGGVNLYAQMIDEADGLEKIENLQSHDNTEIYEKAVKILETYWLEEEDDAMHAGDADQSGFQFGANQQFSAPIGGFNFS

SEQ ID NO: 8347 - protein, 384 aa, Ambrosia trifida
MSLRPNARTEVRRNRYKVAVDADEGRRRREDNMVEIRKNKREENLLKKRQVLPSAQPLLSTGAPVPSSTIEKKLESLPSMVAGVYSNDNNMQLEATTQFRKLLSIERSPPIEEVIQSGVVPRFVEFLMREDYPQLQFEAAWALTNIASGTSENTKVVIDHGAVPIFVKLLGSQSDDVREQAVWALGNVAGDSPRCRDLVLGSGALRPLLHQLNEHAKLSMLRNATWTLSNFCRGKPQPPFEETKPALPALERLVHSNDEEVLTDACWALSYLSDGTNDKIQAVIEAGVCRRLVELLLHPSPSVLIPALRTVGNIVTGDDLQTQCIIEHGALPCLLSLLTNNHKKKHQERSLLDNLKHHCWKQRTNPGCNRSWVNRSPSPSPPDC

SEQ ID NO: 8348 - protein, 141 aa, Arachis hypogaea
MSYRPTGNSRTDVRRSRYKVAVDAEEGRRRREDTMVEIRKNRREESLQKKRREGLQAQQIPASAQSTVTREEVGTPTYDGCRCYLMIIAFSWKQLLSSGSCFRLSAVRRLRRLYRLVSFLALLNFFRGMISPSCSSRQLGL

SEQ ID NO: 8349 - protein, 522 aa, Fagus grandifolia
MSLRPNARTEVRRNRYKVAVDAEEGRRRREDNMVEIRKNRREESLQKKRREGLLAPQMPSTPTSELKLESLPAMVAGVCSEDRNLQLEATTQFRKLLSIERSPPINEVVQSGVVPRFVEFLARDDFPQLQFEAAWALTNIASGTSENTRVVIDHGAVPIFVKLLGSPADDVREQAVWALGNVAGDSPKCRDLVLSHGALMPLLAQFNEHAKLSMLRNATWTLSNFCRGKPPPPFEQTKPAIPALERLIQSNDEEVLTDACWALSYLSDGTNDKIQAVIEAGVCPRLVELLLHPSPTVIIPALRTVGNIVTGDDMQTQCMINHQALPCLLNLLTHNHKKSIKKEACWTISNITAGNVNQIQTVIEAAIIPPLVQLLQNAEFEIKKEAAWAISNATSGGTHEQIKYLVSQGCIKPLCDLLICPDPRIVTVCLEGLENILKVGEAEKNMGNADANLFAQLIDDAEGIDKIENLQSHDNNEIYEKAVKILETYWVEDDEEPLPPGDAAPSSFNFGGNEPSVPSGGI

SEQ ID NO: 8350 - protein, 530 aa, Vinca minor
MSLRPSERTEVRRNRYKVTVDAEEGRRRREDQMVEIRKNKREENLLKKRREGLQMSQPFPTTTPTSNIEKKLESLPSMVAGVWSNDGNLQLEATTQFRKLLSIERSPPIEEVIQSGVVPRFVEFLMREDFPQLQFEAAWALTNIASGTSENTKVVIDHGAVPIFVQLLQSPSDDVREQAVWALGNVAGDSPRCRDLVLSHGALIPLLSQLNEHAKLSMLRNATWTLSNFCRGKPQPPFEQVRPALPALQRLVHSNDEEVLTDACWALSYLSDGTNDKIQAVIEAGVCHRLVELLLHPSPTVLIPALRTVGNIVTGDDFQTQSIIDQGALTCLLSLLTHNHKKSIKKEACWTISNITAGNKEQIQTVIDAQLIGPLVNLLQTAEFDIKKEAAWALSNATSGGTHDQIKYLVSQGCIKPLCDLLVCPDPRIVTVCLEGLENILKVGEVEKNLGNTGDVNYYAQLIDEAEGLEKIENLQSHDNNEIYEKAVKILETYWLEEEDVVLPPGDGAQPGFNFGGNDVQLPSGGFKFG

SEQ ID NO: 8351 - protein, 528 aa, Malus domestica
MSLRPSARTEVRRNRYKVAVDADEGRRRREDNMVEIRKSKREESLLKKRREGLQAQQFAPSLQASNLEKKLESLPAMVAGVWSDDNSLQLESTTQFRKLLSIERSPPIEEVIQSGVVPRFVAFLMREDFPQLQFEAAWALTNIASGTSENTKVVIEQGAVPIFVKLLASPSDDVREQAVWALGNVAGDSPRCRDLVLSSGALMPLLAQLNEHAKLSMLRNATWTLSNFCRGKPQPPFDQVKPALPALERLVHSNDEEVLTDACWALSYLSDGTNDKIQAVIEAGVCVRLVQLLLHPSPSVLIPALRTVGNIVTGDDLQTQCIINNGSLPCLLSLLTHNHKKSIKKEACWTISNITAGNRDQIQSVIEAGLIGPLVNLLQHAEFDIKKEAAWAISNATSGGTPDQIKYLVGEGCIKPLCDLLVCPDPRIVTVCLEGLENILKVGEAEKAAGNSEVNLYAQLVDDAEGLEKIENLQSHDNTEIYEKSVKILETYWLEEDEETLPAGDGSQPGFRFGGSEVQVPSGGFNFS

SEQ ID NO: 8352 - protein, 521 aa, Quercus alba
MSLRPNARTEVRRNRYKVAVDAEEGRRRREDNMVEIRKNRREESLQKKRREGLVAPQMPSTPTSEKKLESLPAMVGGVCSDDMNLQLEATTQFRKLLSIERSPPINEVVQSGVVPRFVEFLARDEFPQLQFEAAWALTNIASGTSENTRVVIDHGAIPIFVKLLGSPADDVREQAVWALGNVAGDSPKCRDLVLSHGALLPLLAQFNEHAKLSMLRNATWTLSNFCRGKPPPPFEQTKPAIPALERLIQSNDEEVLTDACWALSYLSDGTNDKIQAVIDAGVCPRLVELLLHPSPTVLIPALRTVGNIVTGDDMQTQCMINHQALPCLLNLLTHNHKKSIKKEACWTISNITAGNVNQIQAVIEAGIIPPLVQLLQIAEFEIKKEAAWAISNATSGGTHDQIKYLVSQGCIKPLCDLLICPDPRIVTVCLEGLENILKVGEAEKNMGKTDVNLNAQLIDDAEGIDKIENLQSHDNNEIYEKAVKILETYWVEDDDEPLPPGDAPQSSFNFGGNEVPVPSGG

SEQ ID NO: 8353 - protein, 532 aa, Citrus sinensis
MSLRPNARAEVRRNRYKVAVDADEGRRRREDNMVEIRKNKREESLLKKRREGLQSQQFPPPAPASNLNLQTKLESLPAMVAGVWSDDSSLQLEATTQFRKLLSIERSPPIEEVIQSGVVPRFVEFLMREDYPQLQFEAAWALTNIASGTSENTKVVIDHGAVPIFVKLLASPSDDVREQAVWALGNVAGDSPRCRDLVLSQGALIPLLAQLNERAKLSMLRNATWTLSNFCRGKPQPPFDQVRPALPALAQLVHSNDEEVLTDACWALSYLSDGTNDKIQAVIEAGVCPRLVELLGHPSPSVLIPALRTVGNIVTGDDFQTQCIITYGALPYLLGLLTHSHKKSIKKEACWTISNITAGNRDQIQAVIDAGLVGPLVNLLQNAEFDIKKEAAWAISNATSGGTHEQIKYLVREGCIKPLCDLFVCPDPRIVTVCLEGLENILKVGEAEKNMGTATADVNQYAQLVEEAEGLEKIENLQSHDNNEIYEKAVKILETYWLEEDDETIAAGDGPQPGFPYAGNEVQVPSGGFNFS

SEQ ID NO: 8354 - protein, 529 aa, Solanum lycopersicum
MSLRPNARTEVRRNRYKVAVDAEEGRRRREDNMVEIRKNKREENLQKKRREGLQANQQFSVPVQSTVEKKLENLPAMVAGVWTEDGNLQLEATTQFRKLLSIERSPPIEEVIQAGVVPRFVQFLIRDDFPQLQFEAAWALTNIASGTSEHTKVVIESGAVPIFVKLLSSPSDDVREQAVWALGNVAGDSPKCRDLVLNCGALLPLLSQLNPNAKLSMLRNATWTLSNFCRGKPQPAFDQTKPALPALQQLIHSTDEEVLTDACWALSYLSDGTNDKIQAVIDSGVCPRLVELLLHPSPSVLIPALRTVGNIVTGDDMQTQCIIGHQALPCLLNLLSGSHKKSIKKEACWTISNITAGNREQIQCVVDAGIIGPLVNLLQNAEFEIKKEAAWAISNATSGGSHEQIKYLVSQGCIKPLCDLLICPDPRIVTVCLEGLENILKVGEAEKSLGRTSDINLYAQLIDDAEGLEKIENLQSHDNQEIYEKAVKILETYWLEEDDETMPPGDAAQQGFQFGGGEVSVPSGGFSFN

SEQ ID NO: 8355 - protein, 532 aa, Medicago truncatula
MSYRPNANARTEVRRNRYKVAVDAEEGRRRREDNLVEIRKNRREESLQKKRREGLQPQQMPASVQSNLLEKKLEHLPALVTGIWTDDNNMQFEATTQFRKLLSIERSPPIEEVIQAGVVPRFIEFLMREDFPQLQFEAAWALTNIASGTSENTKVVIEAGAVPIFVKLLASPSDDVREQAVWALGNVAGDSPRCRDLVLGHGALLPLLAQLNEHAKLSMLRNATWTLSNFCRGKPQPAFDQVKPALPALASLIHSNDEEVLTDACWALSYLSDGANDKIQGVIEAGVCSRLVELLLHPSPSVLIPALRTVGNIVTGDDLQTQVIINHQVLPPLTNLLINSYKKSIKKEACWTISNITAGNKQQIQDVIDANIIAPLVNLLQNAEFDIKKEAAWAISNATSGGSHEQLKYLVSQGCIKPLCDLLTCPDPRIVTVCLEGLENILKVGEADKNAGITDGVNRYAELIDEAEGLEKIENLQSHDNNEIYEKAVKILETYWLEEDDEAMPPGDASQSGFNFGGSEVPAVPSGGFNFN

SEQ ID NO: 8356 - protein, 217 aa, Valeriana officinalis
MSLRPNARSEIRRSKYKVAVDAEEGRRRREDHMVEIRKNKREESLIKKRCEGLQPQQFPASLHATTVEKKLESLPSMVAGVWSTENNLQLESTTQFRKLLSIERSPPIEEVIQSGVVPRFVEFLMREDFPQLQFEAAWALTNIASGTSENTKVVIDHGAVPIFVKLLGLLVTMFASRLCGHWEMLLVTRLDVAIWFLAVELWFPYLHNLMSMQNFQC

SEQ ID NO: 8357 - protein, 350 aa, Artemisia annua
MSLRPNARTEVRRNRYKVAVDADEGRRRREDNMVEIRKNKREENLQKKRREAVAGGGAANQFPLHSNLQSASTNEKKLENLPAMVAGVWSTDNNLQLEATTQFRKLLSIERSPPIEEVIQSGVVPRFVEFLVREDFPQLQFEAAWALTNIASGTSDHTKVVIEHNAVPIFVKLLASPSDDVREQAVWALGNVAGDSPKCRDLVLGQGALIPLLAQLNEHAKLSMLRNATWTLSNFCRGKPQPSFDQTRPALPALQQLIHSNDEEVLTDACWALSYLSDGTNDKIQAVIEANVCPRLVELLNHPSPSVLIPALRTVGNIVTGDDMQTQYIINHQALPCLLNLLSNNQQKKH

SEQ ID NO: 8358 - protein, 532 aa, Artemisia annua
MSLRPNARTEVRRNRYKVAVDADEGRRRREDNMVEIRKNKREENLLKKRQVLSSSQAVNGGGVPAQPSTVEKKLESLPSMVAGVYSNENNMQLEATTQFRKLLSIERSPPIEEVIQAGVVPRFVEFLMREDFPQLQFEAAWALTNIASGTSDNTKVVIDHGAVPIFVKLLASPSDDVREQAVWALGNVAGDSPRCRDLVLGHGALIPLLSQLNEHAKLSMLRNATWTLSNFCRGKPQPPFEQTRPALPALERLVHSNDEEVLTDACWALSYLSDGTNDKIQAVIDAGVCQRLVELLLHPSPSVLIPALRTVGNIVTGDDLQTQHIIERGALPCLLSLLTNNHKKSIKKEACWTISNITAGNKEQIQTVIEAGLIAPLVNLLQNAEFDIKKEAAWAISNATSGGTNEQIKYLVSQGCIKPLCDLLICPDPRIVTVSLEGLENILKVGEVEKNIGNSGEVNFYAQLIDDAEGLEKIENLQSHDNNEIYEKAVKILETYWLEEEDEAAVVDGAQAGFNFGGNNVQVPSGGFNFNS

SEQ ID NO: 8359 - protein, 531 aa, Theobroma cacao
MSLRPSTRTEVRRNRYKVAVDAEEGRRRREDNMVEIRKSKREESLQKKRREGLQAQQFAASMQSSNAEKKLESLPSLVAGVWSDNGTAQLEGTTQFRKLLSIERSPPIEEVIQSGVVPRFVEFLTREDFPQLQFEAAWALTNIASGTSENTKVVIDHGAVPIFVKLLGSSSDDVREQAVWALGNVAGDSPRCRDLVLSHGALMPLLAQLNEHAKLSMLRNATWTLSNFCRGKPQPPFDQVRPALPALERLVHSNDEEVLTDTCWALSYLSDGTNDKIQAVIEVGVCPRLVELLLNPSPSVLIPALRTVGNIVTGDDLQTQCIIDHGALACLLSLLTHNHKKSIKKEACWTISNITAGNKEQIQAVINAGIIEPLVNLLQNAEFDIKKEAAWAISNATSGGAHQQIKYLISQECIKPLCDLLTCPDPRIITVCLEGLENILKVGEAEKVAGVKDFNFCARMIEDAEGLEKIENLQSHDNNEIYEKAVKILETYWLEEEEEEEETLPPGDGTQQSFQFGANGLQVPSGGFNFS

SEQ ID NO: 8360 - protein, 344 aa, Ambrosia trifida
MSLRPSDRTDLRRNRYKVAVDADEGRRRREDNMVEIRKNRREESLQKKRREGLAANQFPVPVQSASVGEKKLENLPAMVAGLYSDDSSMQLEATTQFRKLLSIERSPPIEEVIKTGVVPRFVQFLMREEYAQLQFESAWALTNIASGTSEHTKVVIDHGAVPIFVKLLSSSSDDVREQAVWALGNVAGDSPKCRDLVLAEDALQSLLLLLNANAKLSMLRNATWTLSNFCRGKPQPAFEQTKPALPALQQLIHSNDEEVLTDACWALSYLSDGTNDKIQAVIESNVCPRLVELLNHPSPTVLIPALRTVGNIVTGDDMQTQYIIDHQALPCLLNLLSNNHKKEH

SEQ ID NO: 8361 - protein, 260 aa, Trigonella foenum-graecum
MSLRPNARTEVRRTHYKNAVDADEGRRRREDTMVEIRKVKREESLLKKRREGLQNQQMFANPLQSSSIVEKKLESLPAMVAGVCSNDNNQQLEATTQFRKLLSIERSPPIEEVIQSGVVPRFVEFLVREDFPQLQFEAAWALTNIASGTSENTKVVIDHGAVPIFVKLLSSPSDDVREQAVWALGNVAGDSPRCRDLVLGNGALIPLLSQLNDQAKLSMLRNATWTLSNFCRGKPQPPFDQVRPALPALERLVFQMMKKS

SEQ ID NO: 8362 - protein, 367 aa, Manihot esculenta
MSLRPSARTEVRRNRYKVAVDADEGRRRREDNMVEIRKSKREESLQKKRREGLQAQQFPPTVISSTMEKKLESLPSMVAGVWSDDGSLQLEATTQFRKLLSIERSPPIEEVIQSGVVPRFVEFLVREDFPQLQFEAAWALTNIASGTSENTRVVIDQGAVPIFVKLLASPSDDVREQAVWALGNIAGDSPKCRDLVLSHGALLPLLAQLNEHAKLSMLRNATWTLSNFCRGKPQPPFEQVRPALPALERLVHSTDEEVLTDACWAQSYLSDGTNDKIQAVIEAGVCPRLIELLLHPSPSVLVPALRTVGNIVTGDDIQTQCVINNGALPYLLSLLTHNHKKSIKKEACWTISNITAGNNQQIQASCN

SEQ ID NO: 8363 - protein, 529 aa, Unknown
  Sequence found in Organisms: Citrus sinensis, Citrus clementina, Citrus sinensis
MSLRPNARTEVRRSKYKVAVDAEEGRRRREDNMVEIRKNKREESLLKKRREGLQAHQPLTNSAALDNKKLESLPAMVAGVWSDDRNIQLDATTQFRKLLSIERSPPINEVIQSGVVPRFIEFLSRDDFPQLQFEAAWALTNIASGTSENTRVVIDHGAVPIFVRLLSSPTDDVREQAVWALGNVAGDSPKCRDLVLSNGALMPLLAQFNEHAKLSMLRNATWTLSNFCRGKPQPLFEQTRPALPALERLIHSNDDEVLTDACWALSYLSDGTNDKIQAVIEAGVCPRLVELLRHPSPSVLIPALRTVGNIVTGDDMQTQCIINHQALPCLLDLLTQNYKKSIKKEACWTISNITAGNVNQIQAIIEAGIIGPLVNLLLNAEFEIKKEAAWAISNATSGGSNEQIKFLVSQGCIKPLCDLLNCPDPRIVTVCLEGLENILKAGEAEKNMGNTGGVNLFAQAIDDAEGLEKIENLQSHDNTEIYEKAVKILETYWVEEDEDEPLPPGDATQAGFGFAGNGLPVPSGGFNFG

SEQ ID NO: 8364 - protein, 532 aa, Citrus clementina
MSLRPNARAEVRRNRYKVAVDADEGRRRREDNMVEIRKNKREESLLKKRREGLQSQQFPPPAPASNLNLQTKLESLPAMVAGVWSDDSSLQLEATTQFRKLLSIERSPPIEEVIQSGVVPRFVEFLMREDYPQLQFEAAWALTNIASGTSENTKVVIDHGAVPIFVKLLASPSDDVREQAVWALGNVAGDSPRCRDLVLSQGALIPLLAQLNERAKLSMLRNATWTLSNFCRGKPQPPFDQVRPALPALAQLVHSNDEEVLTDACWALSYLSDGTNDKIQAVIEAGVCPRLVELLGHPSPSVLIPALRTVGNIVTGDDFQTQCIITYGALPYLLGLLTHSHKKSIKKEACWTISNITAGNRDQIQAVIDAGLVGPLVNLLQNAEFDIKKEAAWAISNATSGGTHEQIKYLVREGCIKPLCDLFVCPDPRIVTVCLEGLENILKVGEAEKNMGTATADVNQYAQLVEEAEGLEKIENLQSHDNNEIYEKAVKILETCWLEEDDETIAAGDGPQPGFPYAGNEVQVPSGGFNFS

SEQ ID NO: 8365 - protein, 532 aa, Fragaria vesca
MSLRPNSKAEGRRNKYKVAVDAEEGRRRREDNMVEIRKNRREESLQKKRREGLPPQQAPPQSPALERKLEHLPSMVAGVWSEEPTLQLEATTQFRKLLSIERSPPIEEVIQSGVVPRFVEFLMREDFPQLQFEAAWALTNIASGTSENTKVVIERGAVPIFVKLLSSPSDDVREQAVWALGNVAGDSPKCRDLVLGNGALIPLLSQLNEHAKLSMLRNATWTLSNFCRGKPQPPFDEVKPALPALARLIHSNDEEVLTDACWALSYLSDGTNDKIQAVIESGVCPRLVELLLHPSPSVLIPALRTVGNIVTGDDMQTQVIIQHQALPCLLTLLTNNHKKSIKKEACWTISNITAGNKDQIQAVVDANLIGPLVQLLSSAEFDIKKEAAWAVSNATSGGSHDQIKILVNHGCIKPLCDLLICPDPRIVTVCLEGLENILKVGEAEKNLGMTGGVNLFAQAIDEAEGLEKIENLQTHDNAEIYEKAVKLLETYWLEDDDGDETMPPGDAATVPTGGFNFGGNAPTVPSGGFNFS

SEQ ID NO: 8366 - protein, 534 aa, Papaver somniferum
MSLRPNARTEVRRNRYKVAVDADEGRRRREDNMVEIRKNKREESLQKKRREGMQAQQFPTSAIQGAGTGVEKKLESLPSMIAGVWSDERELQLEATTQFRKLLSIERSPPIEEVIQSGVVPKFVEFLMREDYPQLQFEAAWALTNIASGTSDNTRVVIESGAVPIFVKLLGSPSDDVREQAVWALGNVAGDSPKCRDLVLGQGALIPLLQQLNEHAKLSMLRNATWTLSNFCRGKPQPPFEQTRPALPALERLIHSTDEEVLTDACWALSYLSDGTNDKIQAVIEANVCPRLVELLMHPSPSVLIPALRTVGNIVTGDDMQTQIIINHQSLPCLLNLLTNNHKKSIKKEACWTISNITAGNKDQIQAVVAAEIIGPLIHLLQTAEFDIKKEAAWAISNATSGGTHEQIKYLVGQGCIRPLCDLLVCPDPRIVTVCLEGLENILKVGEAEKNLGTTGGVNVYAQLIDESEGLEKIENLQSHDNTEIYEKAVKILETYWMEEDDEPLPPGDAAEAAGPSGFQFGGSELPAGGFNFS

SEQ ID NO: 8367 - protein, 500 aa, Cynara scolymus
  misc_feature (377)..(377): Xaa can be any naturally occurring amino acid
  misc_feature (411)..(411): Xaa can be any naturally occurring amino acid
  misc_feature (423)..(423): Xaa can be any naturally occurring amino acid
  misc_feature (446)..(446): Xaa can be any naturally occurring amino acid
  misc_feature (466)..(466): Xaa can be any naturally occurring amino acid
MSLRPSARTEVRRNRYKVAVDAEEGRRRREDNMVEIRKNKREESLQKKRREALTGSQFSVPVQSASAAEKKLENLPAMVAGVWSDDNNMQLEATTQFRKLLSIERSPPIEEVIQSGVVPRFVEFLVREDFPQLQFEAAWALTNIASGTSEHTKVVIDHGAVPIFVKLLASPSDDVREQAVWALGNVAGDSPKCRDLVLGQGALIPLLAQLNEHAKLSMLRNATWTLSNFCRGKPQPSFDQTRPALPALQQLIHSNDEEVLTDACWALSYLSDGTNDKIQAVIEANVCPRLVELLNHPSPSVLIPALRTVGNIVTGDDMQTQYIINHQALPCLLNLLSNNHKKSIKKEACWTISNITAGNKEQIQTVIEANIIGPLVXLLQNAEFDIKKEAAWAISNATSGGSHDQIKYLVXQGCIKPLCDLLXCPDPRIVTVCLEGLENILKVGEXEKNLGRSGDVNLFAQMIDDXEGLEKIENLQSHDNNEIYEKAVKLLETYWLEEED

SEQ ID NO: 8368 - protein, 529 aa, Unknown
  Sequence found in Organisms: Solanum tuberosum, Solanum phureja
MSLRPNARTEVRRNRYKVAVDAEEGRRRREDNMVEIRKNKREENLQKKRREGLQANQQFAVPVQATVEKKLENLPAMVAGVWTEDGNLQLEATTQFRKLLSIERSPPIEEVIQAGVVPRFVQFLMRDDFPQLQFEAAWALTNIASGTSEHTKVVIESGAVPIFVKLLSSPSDDVREQAVWALGNVAGDSPKCRDLVLNCGALLPLLSQLNPNAKLSMLRNATWTLSNFCRGKPQPAFDQTKPALPALQQLIHSTDEEVLTDACWALSYLSDGTNDKIQAVIDSGVCPRLVELLLHPSPSVLIPALRTVGNIVTGDDMQTQCIIGHQALPCLLNLLNGSHKKSIKKEACWTISNITAGNREQIQCVVDAGIIGPLVNLLQNAEFEIKKEAAWAISNATSGGSHEQIKYLVSQGCIKPLCDLLICPDPRIVTVCLEGLENILKVGEAEKNLGRTSDINLYAQLIDDAEGLEKIENLQSHDNQEIYEKAVKILETYWLEEDDETMPPGDAPQQGFQFGGGEVSVPSGGFSFN

SEQ ID NO: 8369 - protein, 520 aa, Glycine max
MSLRPNARTEVRRNRYKVAVDADEGRRRREDNMSLLKKRREGLQAHQQLPAPLQNSTVDKNLESLPAMVAGVWSNDNSLQLEATTQFRKLLSIERSPPIEEVIQAGVVPRFVEFLVREDFPQLQFEAAWALTNIASGTSENTKVVIDHGAVPIFVKLLSSPSDDVREQAVWALGNVAGDSPRCRDLVLSHGALVPLLAQLNEHAKLSMLRNATWTLSNFCRGKPQPPFEQVRPALPALERLVFSNDEEVLTDACWALSYLSDGTNDKIQAVIEAGVCPRLMQLLMHPSPSVLIPALRTVGNIVTGDDMQTQCIINHGALPCLLNLLTNNHKKSIKKEACWTISNITAGNKEQIQTVIEAGLVAPLVNLLQSAEFDIKKEASWAISNATSGGTHDQIKYLVSQGCVKPLCDLLVCPDPRIVTVCLEGLENILKVGEAEKSLGNTGDVNVYAQMIDEAEGLEKIENLQSHDNNEIYEKVVKILETYWLEEEDETLPSGNGAQPGFNFGNNELPVPSGGFNFS

SEQ ID NO: 8370 - protein, 534 aa, Gossypium hirsutum
MSLRPNARAEVRRNRYKVAVDAEEGRRRREDNMVEIRKNKREENLLKKRREGLLSQQQQPQQQQLLSSAAGSEKKLESLPAMVAGVWSDDRNMQLEATTQFRKLLSIERSPPINEVVQSGVIPRFVEFLARDDFPQLQFEAAWALTNIASGTSDNTRVVIDHGAVPIFVKLLGSPTDDVREQAVWALGNVAGDSPKCRDLVLGHGALMPLLAQFNDHAKLSMLRNATWTLSNFCRGKPQPSFEQTRPALPTLERLIHSNDEEVLTDACWALSYLSDGTNDKIQAVIDSGVCPRLVELLLHPSPTVLIPALRTVGNIVTGDDMQTQCIINHQALPCLLNLLTSNYKKSIKKEACWTISNITAGNVDQIQAVISAGIFAPLVHLLQNAEFEIKKEAAWAISNATSGGTHEQIKFLVSQGCIKPLCDLLNCPDPRIVTVCLEGLENILKVGVAEKNLGHTREVNLYAQLIDDAEGLEKIENLQSHDNNEIYEKAVKILETYWVEEEDEPLPPGDASQSGFQFGGNQLPVPSGGFNFS

SEQ ID NO: 8371 - protein, 530 aa, Malus domestica
MSLRPNARAEVRRNRYKVAVDAEEGRRRREDNMVEIRKNRREESLQKKRREGLQTQQLPSSLHSAGLDKKLEHLPSMVAGVWGDEGTMQLEATTQFRKLLSIERSPPIEEVIQAGVVPRFVEFLMREDFPQLQFEAAWALTNIASGTSDNTRVVIDHGAVPIFVKLLSSPSDDVREQAVWALGNVAGDSPRCRDLVLGNGALLPLLSQLNENAKLSMLRNATWTLSNFCRGKPQPPFEQVKPALPALARLIHSNDEEVLTDACWALSYLSDGTNDKIQAVIESGVCPRLVELLMHPSPSVLIPALRTVGNIVTGDDMQTQVIIQHQALPCLLNLLTNNYKKSIKKEACWTISNITAGNKEQIRAVVEANIIGPLVNLLQNAEFDIKKEAAWAISNATSGGSHEQIKFLVSQGCIKPLCDLLVCPDPRIVTVCLEGLENILKVGEAEKNLGTTGGVNLYAQAIEDADGLEKIESLQSHDNTEIYEKAVKMLETYWLEDDDETMPPGDAAPTTFNFGGNDVPTVPSGGFNFG

SEQ ID NO: 8372 - protein, 530 aa, Helianthus annuus
MSLRPSARTEVRRNRYKVAVDADEGRRRREDNMVEIRKNKREENLLKKRQLLSSSQSLAAGVPVQASTVEKKLESLPSMVAGVYSNDNNMQLEATTQFRKLLSIERSPPIEEVIQSGVVPRFVEFLMREDFPQLQFEAAWALTNIASGTSDNTKVVIEHGAVPIFVKLLASPSDDVREQAVWALGNVAGDSPRCRDLVLGHGALMPLLAQLNENAKLSMLRNATWTLSNFCRGKPQPPFEQTRPALPALQRLIHSNDEEVLTDACWALSYLSDGTNDKIQAVIDAGVCQRLVELLLHPSPSVLIPALRTVGNIVTGDDLQTQHIIECGVLPCLLSLLTHNHKKSIKKEACWTISNITAGNKEQIRTVIEAGLIAPLVNLLQTAEFDIKKEAAWAISNATSGGTNEQIKYLVNQGCIKPLCDLLVCPDPRIVTVSLEGLENILKVGEVEKQAGNSGDVNFFAQLIDDADGLEKIENLQSHDNNEIYEKAVKILETYWLDEDDENVADGGQAGFDFGGNNVQVPSGGFNFNS

SEQ ID NO: 8373 - protein, 534 aa, Gossypium raimondii
MSLRPNARAEVRRNRYKVAVDAEEGRRRREDNMVEIRKNKREENLLKKRREGLLSQQQQPQQQQLLSSAAGSEKKLESLPAMVAGVWSDDRNMQLEATTQFRKLLSIERSPPINEVVQSGVIPRFVEFLARDDFPQLQFEAAWALTNIASGTSDNTRVVIDHGAVPIFVKLLGSPTDDVREQAVWALGNVAGDSPKCRDLVLGHGALMPLLAQFNDHAKLSMLRNATWTLSNFCRGKPQPSFEQTRPALPTLERLIHSNDEEVLTDACWALSYLSDGTNDKIQAVIDSGVCPRLVELLLHPSPTVLIPALRTVGNIVTGDDMQTQCIINHQSLPCLLNLLTSNYKKSIKKEACWTISNITAGNVDQIQAVISAGIFAPLVHLLQNAEFEIKKEAAWAISNATSGGTHEQIKFLVSQGCIKPLCDLLNCPDPRIVTVCLEGLENILKVGVAEKNLGHTREVNLYAQLIDDAEGLEKIENLQSHDNNEIYEKAVKILETYWVEEEDEPLPPGDASQSGFQFGGNQLPVPSGGFNFS

SEQ ID NO: 8374 - protein, 534 aa, Gossypium hirsutum
MSLRPNARAEVRRNRYKVAVDAEEGRRRREDKMVEIRKNKREENLLKKRREGLLSQQQQPQQQQLLSSAAGSEKKLESLPAMVAGVWSDDRNMQLEATTQFRKLLSIERSPPINEVVQSGVIPRFVEFLARDDFPQLQFEAAWALTNIASGTSDNTRVVIDHGAVPIFVKLLGSPTDDVREQAVWALGNVAGDSPKCRDLVLGHGALMPLLAQFNDHAKLSMLRNATWTLSNFCRGKPQPSFEQTRPALPTLERLIHSNDEEVLTDACWALSYLSDGTNDKIQAVIDSGVCPRLVELLLHPSPTVLIPALRTVGNIVTGDDMQTQCIINHQSLPCLLNLLTSNYKKSIKKEACWTISNITAGNVDQIQAVISAGIFAPLVHLLQNAEFEIKKEAAWAISNATSGGTHEQIKFLVSQGCIKPLCDLLNCPDPRIVTVCLEGLENILKVGEAEKNLGHTGEVNLYAQLIDDAEGLEKIENLQSHDNNEIYEKAVKILETYWVEEEDEPLPPGDASQSGFQFGGNQLPVPSGGFNFS

SEQ ID NO: 8375 - protein, 534 aa, Oryza sativa
MSLRPSERAEVRRSRYKVAVDADEGRRRREDNMVEIRKSRREESLLKKRRDGLPAAAAAAAAASPLLAHSSALQQKLEGLPAMVQAVQSDDSAVQLEATTQFRKLLSIERSPPIEEVINTGVVPRFIAFLQREDYPQLQFEAAWALTNIASGTSDNTKVVVESGAVPIFVKLLSSPSEDVREQAVWALGNVAGDSPKCRDLVLASGGLYPLLQQLNEHAKLSMLRNATWTLSNFCRGKPQPNFEQVKPALSALQRLIHSQDEEVLTDACWALSYLSDGTNDKIQAVIESGVFPRLVELLMHPSASVLIPALRTVGNIVTGDDMQTQCVIDHQALPCLLNLLTNNHKKSIKKEACWTISNITAGNREQIQAVINANIIAPLVHLLQTAEFDIKKEAAWAISNATSGGTHDQIKYLVAQGCIKPLCDLLVCPDPRIVTVCLEGLENILKVGEAEKNLGAGDVNSYAQMIDDAEGLEKIENLQSHDNTEIYEKAVKMLESYWLEEEDDAMPSGDNAQNGFNFGNQQPNVPSGGFNFG

SEQ ID NO: 8376 - protein, 532 aa, Trigonella foenum-graecum
MSYRPNSNARTDVRRNRYKVAVDAEEGRRRREDNLVEIRKNRREESLQKKRREGLQPQQMPASVQSNLLEKKLEHLPALVTGIWTDDNNMQFEATTQFRKLLSIERSPPIEEVIQAGVVPRFIEFLMREDFPQLQFEAAWALTNIASGTSENTKVVIEAGAVPIFVKLLASPSDDVREQAVWALGNVAGDSPKCRDLVLGHGALLPLLAQLNEHAKLSMLRNATWTLSNFCRGKPQPAFEQVKPALPALASLIHSNDEEVLTDACWALSYLSDGANDKIQGVIDAGVCSRLVELLLHPSPSVLIPALRTVGNIVTGDDMQTQVIINHQVLPCLMSLLTNNYKKSIKKEACWTISNITAGNKQQIQDVIEANIIGPLVHLLQNAEFDIKKEAAWAISNATSGGSHEQLKYLVSQGCIKPLCDLLICPDPRIVTVCLEGLENILKVGEADKNVSNTDGVNLYAQMIDDAEGLEKIENLQSHDNTEIYEKAVKILETYWLEEDDEAMPPGDASQSGFNFGGSEVPAVPSGGFNFN

SEQ ID NO: 8377 - protein, 531 aa, Tropaeolum majus
MSLRPNARTEVRRSRYKVAVDADEGRRRREDNMVEIRKNRREESLQKKRREGIQAQPMPASLQSNSAEKLEHLPSMVAGVWSDENNLQLEATSQFRKLLSIERSPPIEEVIQAGVVPRFVEFLMREDFPQLQFEAAWALTNIASGTSENTKVVIDHGAVPIFAKLLGSPSDDVREQAVWALGNVAGDSPKCRDLVLGHGALLPLLSQLNENAKLSMLRNATWTLSNFCRGKPQPAFDQVKPALPALAQLIHSNDEEVLTDACWALSYLSDGTNDKIQAVIEAGVFPRLIELLVHPSPSVLIPALRTVGNIVTGDDMQTQYVINYQALPALLNLLTSNCKKSIKKEACWTISNITAGNKDQIQSVIESNLIAPLAHLLQNAEFDIKKEAAWAISNATSGGTHDQIKFLVSQGCIKPLCDLLICPDPRIVTVCLEGLENILKVGEADKNLGNTGDVNLFAQVIEDVDGLEKIENLQSHDNSEIYEKSVKLLETYWVEEDEEETTVPGDGNAQSGFSFGGGDGPAVPSGGFNFN

SEQ ID NO: 8378 - protein, 533 aa, Orobanche aegyptiaca
MSLRPNARAEVRRNKYKVAVDAEEGRRRREDNMVEIRKNRREESLQKKRREGIQQFGVPVEATTGIEKKVQLENLPSMVASVWTDDGNTQLEATTQFRKLLSIERSPPIQEVIQAGVVPRFVEFLTREDFPQLQFEAAWALTNIASGTSEHTKVVIDHGAVPIFVQLLGSPSDDVREQAVWALGNVAGDSPKCRDLVLSHGALGPLLAQLNEHAKLSMLRNATWTLSNFCRGKPQPVFDQTRPALPVLRQLIHSNDEEVLTDACWALSYLSDGTNDKIQAVIDCGVCPRLVELLLHPSPSVLIPALRTVGNIVTGDDIQTQYIISYNALPCLLNLMSGAHKKSIKKEACWTISNITAGNRDQIQAVIEANIIGPLVELLQNAEFEVKKEAAWAISNATSGGTHEQIKYLVSQQCIKPLCDLLVCPDPRIVTVCLEGLENILKIGEADKNLGLTGDTNIYAQMIDDAEGLEKIENLQSHDNNEIYEKAVKMLESYWLEEDEDDQPGPPGDGAAQQNFQFGGGDASVPTGGFSFT

SEQ ID NO: 8379 - protein, 518 aa, Ambrosia trifida
MSLRPSDRTDLRRNRYKVAVDADEGRRRREDNMVEIRKNRREESLQKKRREGLAANQFPVPVQSASVSEKKLENLPAMVAGLYSDDSSMQLEATTQFRKLLSIERSPPIEEVIKTGVVPRFVQFLMREEYPQLQFESAWALTNIASGTSEHTKVVIEHGAVPIFVKLLASSSEDVREQAVWALGNVAGDSPKCRDLVLVEGALQSLLSLLNANAKLSMLRNATWTLSNFCRGKPQPAFEQTKPALPALQQLIHSNDEEVLTDACWALSYLSDGTNDKIQAVIEANVCPRLVELLNHPSPTVLIPALRTVGNIVTGDDMQTQYIIDHQALPCLLNLLSNNHKKSIKKEACWTISNITAGNKEQIQTVIAANLIGPLVHLLQNAEFDIKKEAAWAISNATSGGSHDQIKYLVSQGCIKPLCDLLVCPDPRIVTVCLEGLENILKVGESEKNLGRSGDTNLYAQMIDDAEGLEKIENLQSHDNNEIYEKAVKLLETYWVEEEDDDVMPPGEIAQPGFNLWR

SEQ ID NO: 8380 - protein, 535 aa, Arabidopsis thaliana
MSLRPNAKTEVRRNRYKVAVDAEEGRRRREDNMVEIRKSKREESLQKKRREGLQANQLPQFAPSSVPASSTVEKKLESLPAMVGGVWSDDRSLQLEATTQFRKLLSIERSPPIEEVIDAGVVPRFVEFLTREDYPQLQFEAAWALTNIASGTSENTKVVIEHGAVPIFVQLLASQSDDVREQAVWALGNVAGDSPRCRDLVLGQGALIPLLSQLNEHAKLSMLRNATWTLSNFCRGKPQPPFDQVRPALPALERLIHSTDEEVLTDACWALSYLSDGTNDKIQSVIEAGVVPRLVELLQHQSPSVLIPALRSIGNIVTGDDLQTQCVISHGALLSLLSLLTHNHKKSIKKEACWTISNITAGNRDQIQAVCEAGLICPLVNLLQNAEFDIKKEAAWAISNATSGGSPDQIKYMVEQGVVKPLCDLLVCPDPRIITVCLEGLENILKVGEAEKVTGNTGDVNFYAQLIDDAEGLEKIENLQSHDNSEIYEKAVKILETYWLEEEDETLPPGDPSAQGFQFGGGNDAAVPPGGFNFQ

SEQ ID NO: 8381 - protein, 535 aa, Arabidopsis lyrata
MSLRPNAKTEVRRNRYKVAVDAEEGRRRREDNMVEIRKSKREESLQKKRREGLQANQLPQFAPSSVPASSTVEKKLESLPSMVGGVWSDDRSLQLEATTQFRKLLSIERSPPIEEVIDAGVVPRFVEFLTREDYPQLQFEAAWALTNIASGTSENTKVVIEHGAVPIFVQLLASQSDDVREQAVWALGNVAGDSPRCRDLVLGQGALIPLLSQLNEHAKLSMLRNATWTLSNFCRGKPQPPFDQVRPALPALERLIHSTDEEVLTDACWALSYLSDGTNDKIQSVIEAGVVPRLVELLQHQSPSVLIPALRSIGNIVTGDDLQTQCVISHGALLSLLSLLTHNHKKSIKKEACWTISNITAGNRDQIQAVCEAGLICPLVNLLQNAEFDIKKEAAWAISNATSGGSPDQIKYMVEQGVVKPLCDLLVCPDPRIITVCLEGLENILKVGEAEKVTGNTGDVNFYAQLIDDAEGLEKIENLQSHDNSEIYEKAVKILETYWLEEEDETLPPGDPSAQGFQFGGGNDAAVPPGGFNFK

SEQ ID NO: 8382 - protein, 530 aa, Brassica napus
MSLRPNARTEVRRNRYKVAVDAEEGRRRREDNMVEIRKTKREESLLKKRREGLQATQLPQVTSAASSVEKKLESLPSMVGGVWSDDRSLQLEATTQFRKLLSIERSPPIEEVIGAGVVPRFVDFLMREDYPQLQFEAAWALTNIASGTSEHTKVVIQHDAVPIFVQLLASQSDDVREQAVWALGNVAGDSPQCRDLVLSKGALLPLLSQLNEHAKLSMLRNATWTLSNFCRGKPQPPFDQVRPALPALERLIHSTDEEVLTDACWALSYLSDGTNDKIQSVIEAGVVPRLVELLQHPSPSVLIPALRSIGNIVTGDDAQTQCVISHGALLCLLSLLTQNHKKSIKKEACWTISNITAGNRDQIQAVCEAGLIAPLVNLLQNAEFDIKKEAAWAVSNATSGGSADQIKYMVDQGVVKPLCDLLVCPDPRIITVCLEGLENILKVGEAEKVTGNTGDANYYAQLIDDAEGLEKIENLQSHDNSEIYEKAVKILETYWLEEEDETLPPGDESAQGFQFGGSDAAAPPGGFNFK

SEQ ID NO: 8383 - protein, 531 aa, Cicer arietinum
MSYRPTANARTDVRRNRYKVAVDAEEGRRRREDTMVEIRKNRREESLQKKRREGLAQQMPASAQSTLIEKKLEHLPSLVTGIWTDDNNMQFEATTQFRKLLSIERSPPIEEVIQAGVVPRFVEFLMREDFPQLQFEAAWALTNIASGTSENTKVVIDHGAVPIFVQLLASPSDDVREQAVWALGNVAGDSPRCRDLVLSHGALLPLLAQLNEHAKLSMLRNATWTLSNFCRGKPQPAFEQVKPALPALASLIHSNDEEVLTDACWALSYLSDGTNDKIQGVIDAGVCSRLVELLLHPSPSVLIPALRTVGNIVTGDDMQTQVIINHQVLPSLLNLLTNNYKKSIKKEACWTISNITAGNKQQIQAVIDANIFGPLVHLLQNAEFDIKKEAAWAISNATSGGSHEQLKYLVSQGCIKPLCDLLICPDPRIVTVCLEGLENILKVGEADKNVSNTDGVNLYAQMIDDAEGLEKIENLQSHDNTEIYEKAVKILETYWLEDEDETMPPGDASQSGFNFGGSEVPSVPTGGFNFN

SEQ ID NO: 8384 - protein, 534 aa, Eutrema halophilum
MSLRPNARTEVRRNRYKVAVDAEEGRRRREDNMVEIRKNKREESLQKKRREGLQATQQPQFAPSSVTGASSVEKKLESLPSMVGGVWSEDRNLQLEATTQFRKLLSIERSPPIEEVIDAGVVPRFVEFLMREDYPQLQFEAAWALTNIASGTSENTKVVIEHGAVPIFVKLLASQSDDVREQAVWALGNVAGDSPRCRDLVLSQGALLPLLSQLNEHAKLSMLRNATWTLSNFCRGKPQPPFDQVRPALPALERLIHSTDEEVLTDACWALSYLSDGTNDKIQSVIEAGVVPRLVELLRHPSPSVLIPALRSIGNIVTGDDAQTQCVISHGALLSLLSLLTHNHKKSIKKEACWTISNITAGNRDQIQAVCEAGLICPLVNLLQNAEFDIKKEAAWAISNATSGGSPDQIKYMVEQGVVKPLCDLLICPDPRIITVCLEGLENILKVGEAEKVTGNTGDVNFYAQLIDDAEGLEKIENLQSHDNSEIYEKAVKILETYWLEEEDEALPPGDGSAQGFQFGGNDAAAPPGGFNFT

SEQ ID NO: 8385 - protein, 530 aa, Brassica rapa
MSLRPNARTEVRRNRYKVAVDAEEGRRRREDNMVEIRKTKREESLLKKRREGLQATQLPQVTSAASSVEKKLESLPSMVGGVWSDDRSLQLEATTQFRKLLSIERSPPIEEVIDAGVVPRFVEFLMREDYPQLQFEAAWALTNIASGTSEHTKVVIQHDAVPIFVQLLASQSDDVREQAVWALGNVAGDSPQCRDLVLSKGALLPLLSQLNEHAKLSMLRNATWTLSNFCRGKPQPPFDQVRPALPALERLIHSTDEEVLTDACWALSYLSDGTNDKIQSVIEAGVVPRLVELLQHPSPSVLIPALRSIGNIVTGDDAQTQCVISHGALLCLLSLLTQNHKKSIKKEACWTISNITAGNRDQIQAVCEAGLIGPLINLLQNAEFDIKKEAAWAVSNATSGGSADQIKYMVDQGVVKPLCDLLVCPDPRIITVCLEGLENILKVGEAEKVTGNTGDANYYAQLIDDAEGLEKIENLQSHDNSEIYEKAVKILETYWLEEEDETLPPGDESAQGFQFGGSDAAAPPGGFNFK

SEQ ID NO: 8386 - protein, 508 aa, Tabernaemontana elegans
MSLRPNERTEVRRNRYKVAVDAEEGRRRREDQMVEIRKSKREENLLKKRREGLQISVLPFSTTTPANNVEKKLESLLSMVTGVCSNDSSLQLEATTQFRKLLSIERSPPIEEVIQSGVVPRFVEFLMREDFPQLQFEAAWALTNIASGTSENTKVVIDHGAVPIFVKLLGSPSDDVREQAVWALGNVAGDSPRCRDLVLSHGALIPLLSQLNEHAKLSMLRNATWTLSNFCRGKPQPPFEQVRPALPALQRLVTSTDEEVLTDACWALSYLSDGTNDKIQAVIEAGVCHRLVELLLHPSPSVLIPALRTVGNIVTGDDVQTQFIIDEGALNSLLSLLTHNHKKSIKKEACWTISNITAGNKEQIQAVIDAQLIGPLVNLLQTAEFDIKKEAAWAISNATSGGTHDQIKYLVSQGCIKPLCDLLVCPDPRIVTVCLEGLENILKVGEVEKSLGNSGDVNYYAQLIDEAEGLEKIENLQSHDNTEIYEKAVKILETYWLEEEDDAALVTG

SEQ ID NO: 8387 - protein, 440 aa, Saccharum officinarum
ATTQFRKLLSIERSPPIEEVIKSGVVPRFVQFLTREDFPQLQFEAAWALTNIASGTSENTKVVIDHGAVPIFVKLLGSASDDVREQAVWALGNVAGDSPKCRDLVLANGALMPLLAQLNEHAKLSMLRNATWTLSNFCRGKPQPSFDQTKPALPALARLIHSNDEEVLTDACWALSYLSDGTNDKIQAVIEAGVCPRLVELLLHPSPSVLIPALRTVGNIVTGDDMQTQCIIDHQALPRLLNLLTQNHKKSIKKEACWTISNITAGNKDQIQAVISAGIIGPLLQLLQTAEFDIKKEAAWAISNATSGGSHEQIKYLVAEGCIKPLCDLLVCPDPRIVTVCLEGLENILKVGEHDKTMGGATADGNLFAQMIDEAEGLEKIENLQSHDNNEIYEKAVKLLEAYWMEEEDDAMATAGEAAPAVFDFSQGGNPPAGGGLNFN

SEQ ID NO: 8388 - protein, 197 aa, Zostera marina
MSLRPSARTEVRRNRYKVTVDADEGRRRREDNMVEIRKTRREESLLKKRREGMNSQQQLLPSLSSSNMEKKLESLPVMISGVYSDDHNLQVEATTQFRKLLSIERSPPIQEVIQAGVVPRFIEFLMREDVPQLQFEAAWALTNIASGTSDHTKVVIDHGAVPIFVKLLGSPSDDVREQAVWALGNVAGDSPKCRDLF

SEQ ID NO: 8389 - protein, 533 aa, Ricinus communis
MSLRPSARTEVRRNKYKVAVDAEEGRRRREENIIEIRKNKREENLQKKRREGLQAAQQQQLTSSFANATIDKKLESLPAMVAGVWSEDKNAQLEATTHFRKLLSIERSPPINEVVQSGVVPRFIEFLARDDFPQLQFEAAWALTNIASGTSENTKVVIDHGAVPIFIKLLSSPTDDVREQAVWALGNIAGDSPKCRDFVLGHGALMPLLAQFNEHAKLSMLRNATWTLSNFCRGKPQPSFEQTKPALPALERLIHSNDEEVLTDACWALSYLSDGTNDKIQAVIEAGVCPRLVELLLHPSPTVLIPALRTVGNIVTGDDMQTQCMINHQALPCLLNLLTHNYKKSIKKEACWTISNITAGNVNQIQAIIDADLIGPLIQLLQIAEFEIKKEAAWAISNATSGGTHEQIKYLVSQGCIKPLCDLLICPDPRIVTVCLEGLENILKVGEAEKNLGNTGDANLYAQMIDEAEGLEKIENLQSHDNNDIYEKAVKILETYWLEEDEDEALAPADASQSGFHFGGNEVPAPSGGFKFG

SEQ ID NO: 8390 - protein, 528 aa, Gossypium raimondii
MSLRPSTRTEARRNRYKVAVDAEEGRRRREDNMVEIRKSKREESLLKKRREGLQAQQFAASLHSSNVEKKLESLPSMVAGVWSDNGAAQLEATTQFRKLLSIERSPPIEEVIQSGVVPRFVEFLGREDFPQLQFEAAWALTNIASGTSDNTKVVIDLGAVPIFVKLLASPSDDVREQAVWALGNIAGDSPRCRDLVLSHGALMPLLAQLNEHAKLSMLRNATWTLSNFCRGKPQPPFEQVTPALPALERLVHSNDEEVLTDACWALSYLSDGTNDKIQAVIQAGVCPRLVELLLNPSPSVLIPALRTVGNIVTGDDLQTQCIIDHGALACLMNLLTNNYKKSIKKEACWTISNITAGNKEQIQAVINAGLIGPLVNLLQNAEFDVKKEAAWAISNATSGGAHEQIKYMVSQGCIKPLCDLLACPDPRIIMVCLEGLENFLKVGEAEKATGAVEFNFCAQLIEDADGLEKIENLQTHDNSEIYEKAVKILETYWLEEDEETLPPADGTQQSFQFGENGLQVPSGGFNFS

SEQ ID NO: 8391 - protein, 533 aa, Manihot esculenta
MSLRPSARTEVRRNKYKVAVDAEEGRRRREDNMVEIRKNKREESLQKKRREGLQAQQQQLTSFSNSSTTDKKLESLPAMVAGVWSEDRNSQLEATTHFRKLLSIERSPPINEVVQSGVVPRFIEFLARDDFPQLQFEAAWALTNIASGTSENTKVVIDHGAVPIFIKLLSSPTDDVREQAVWALGNIAGDSPKCRDLVLGCGALMPLLAQFNEHAKLSMLRNATWTLSNFCRGKPQPLFEQTKPALPALERLIHSNDEEVLTDACWALSYLSDGTNDKIQAVIEAGVCPRLVELLLHSSPTVLIPALRTVGNIVTGDDMQTQCMINHQTLPCLLNLLTHNYKKSIKKEACWTISNITAGNINQVQAIIEAGIIAPLVQLLQNAEFEIKKEAAWAISNATSGGTHEQIKFLVNQGCIKPLCDLLICPDPRIITVCLEGLENILKVGEAEKNLGNTGDANLYAQMIDDAEGLEKVENLQSHDNNDIYEKAVKILETYWLDEEDDDEATHQGDAPVDGYNFGGSEFTVPSGGFKFS

SEQ ID NO: 8392 - protein, 261 aa, Sorghum bicolor
MASLLFVPRPTRSACAKTGPSATHKPRRVSITCGPRDNRGPLQRGRSLSTEAILAIQSLKRLTSADRSPAAATAAAATALGRLLKADLVAAMAELQRQGHWSLALAVLHVARAEPWYRPDPALYATFVSSAPTSSPSGEAEAAVDALVEAFLEEKARGGGFVDGEEDVYKLTRLLRALVAKARGRAAWKVYEAAVRKGGLDVDEYVYRVMARGMKRLGLHEEAAEVEADFAEWEATVSPPARDVLDEMRARDESKTTASAT

SEQ ID NO: 8393 - protein, 263 aa, Setaria italica
MASLLFVPRPTPGSRPAPAPTARPRTVSIITCGPRDNRGPLQRGRSLSTEAILGIQSLKRLTAADRSPAAASAAAASALGRLLKADLVAAMAELQRQGHWSLALAALHVARGEPWYRPDPALYATFVSSAPAAAASGGDDEAGAAVDALVEAFLEEKARGGGFVDGEEDVYKLTRLLRALVARDRGRAAWKVYEAAVREGGLDVDEYVYRVMARGMRRLGLDEEAALAEADLAEWEATISPPARDVLDEMRARDKSKTKASAS

SEQ ID NO: 8394 - protein, 527 aa, Setaria italica
MDDGSASASPSSASPHQHHRDAIKSSVHNSASSRRREHAIAVGKERREALMRAKRVCRAPLSGNDETVMEEGDMVIDEKKADLEAQTAQAVEELKSALSTQGKGAQKKKIEVLRALRRLLSQSEVPPVEAAIKAGAIPLLVQYLSFGSSDEQLLEAAWCLTNIAAGEPEETKSLLPALPLLIAHLGEKSSTLVAEQCAWAIGNVAGEGADLRSKLLAQGALWPLARLMLSNKGSTARTAAWALSNLIKGPDPKAANELISIDGVLNAIIRNLEKADEELATEVAWVVVYLSALSEKATSLIVRSSVPQLLIGRLLASENLQLLIPVLRSLGNLVAGDGYMVDSVLTVGNSITDQALSSLIKCLKSDNRVLKKEASWAMSNIAAGSFEHKKLIFASEAMTLLMHLLTTAQFDIRREAAYTLGNMCVVPAGNAAPPNIIVDHLVAIVNGGALPGFINLVRSADIESARLGLQFLELVMRGYPNGQGPKLVESEDGIEAMERFQFHENELMRNMANGLVDKYFGEDYGLE

SEQ ID NO: 8395 - protein, 263 aa, Setaria italica
MASLLFVPRPTPGSRPAPAPTARPRTVSIITCGPRDNRGPLQRGRSLSTEAILGIQSLKRLTAADRSPAAASAAAASALGRLLKADLVAAMAELQRQGHWSLALAALHVARGEPWYRPDPALYATFVSSAPAAAASGGDDEAGAAVDALVEAFLEEKARGGGFVDGEEDVYKLTRLLRALVARDRGRAAWKVYEAAVREGGLDVDEYVYRVMARGMRRLGLDEEATLAEADLAEWEATISPPARDVLDEMRARDKSKTKASAS

SEQ ID NO: 8396 - protein, 205 aa, Zea mays
MRIVGDGAVETWAAADEAMRANLRILAGEEKTREILDKLEKSTCSTNPISTPAVEKVMNALKASCADLHSIVEDPLPAAKAVADELLAARMEKRVSLNAEVGGQPTTCGAAGPSIHNDKDNGPGIGKPHSLMERNATARTSQWEESHGLDGSEPPSPPRPRLPSPRRLPPSPLPPPEQNTKRRRQSELSKRNLERCESMYCLMSV

SEQ ID NO: 8397 - protein, 508 aa, Triticum aestivum
MGLPWYRVHTVVLNDPGRLLAVHIMHTALVSGWAGSMALYELAVFDPSDPVLDPMWRQGMFVIPFMTRLGITDSWGGWSISGGTVTNPGIWSYEGVAGTHIVFSGLCFLAAIWHWVYWDLEIFSDERTGKPSLDLPKIFGIHLFLAGVACFGFGAFHVTGLYGPGIWVSDPYGLTGKVQAVNPAWGAEGFDPFVPGGIASHHIAAGTLGILAGLFHLSVRPPQRLYKGLRMGNIETVLSSSIAAVFFAAFVVAGTMWYGSATTPIELFGPTRYQWDQGYFQQEIYRRVSNGLAENLSLSEAWSKIPEKLAFYDYIGNNPAKGGLFRAGSMDNGDGIAVGWLGHPVFRDKEGRELFVRRMPTFFETFPVVLVDEEGIVRADVPFRRAESKYSVEQVGVTVEFYGGELNGVSYSDPATVKKYARRSQLGEIFELDRATLKSDGVFRSSPRGWFTFGHATFALLFFFGHIWHGARTLFRDVFAGIDPDLDAQVEFGTFQKVGDPTTRKQAA

SEQ ID NO: 8398 - protein, 101 aa, Amorphophallus konjac
MKAFHLLLFHGSFIFPECILIFGLILLLMIDLTSDQKDRPWFYFISSTSLVMSITALLFRWREEPMISFSGNFQTNNFNEIFQFSYFTMFNFMYSSIRRVH

SEQ ID NO: 8399 - protein, 492 aa, Unknown
  Sequence found in Organisms: Sorghum bicolor, Saccharum officinarum
MKAFHLLLFNGSFIFPECILIFGLILLLMIDLTSDQKDRPWFYFISSTSLVISITALLFRWREEPIISFSGNFQTNNFNEIFQFLILLCSTLCIPLSVEYIECTEMAITEFLLFVLTATLGGMFLCGANDLITIFVAPECFSLCSYLLSGYTKRDLRSNEATMKYLLMGGASSSILVHGFSWLYGSSGGEIELQEIVNGLINTQMYNSPGISIALIFITVGLGFKLSPAPFHQWTPDVYEGSPTPVVAFLSVTSKVAASALATRILDIPFYFSSNEWHLLLEILAILSMILGNLLAITQTSMKRMLAYSSIGQIGYVIIGIIVGDSNDGYASMITYMLFYISMNLGTFACIVLFGLRTGTDNIRDYAGLYTKDPFLALSLALCLLSLGGLPPLAGFFGKLYLFWCGWQAGLYFLVSIGLLTSVLSIYYYLKIIKLLMTGRNQEITPYVRNYRRSPLRSNNSIELSMTVCVIASTIPGISMNPILAIAQDTLF

SEQ ID NO: 8400 - protein, 492 aa, Hordeum vulgare
MKAFHLLLFNGSFIFPECILIFGLILLLMIDLTSDQKDRPWFYFISSTSLVISITALLFRWREEPIISFSGNFQTNNFNEIFQFLILLCSTLCIPLSVEYIECTEMAITEFLLFVLTATLGGMFLCGANDLITIFVALECFSLCSYLLSGYTKRDLRSNEATMKYLLMGGASSSILVYGFSWLYGSSGGEIELQEIVNGLINTQMYNSPGISIALISITVGLGFKLSPAPFHQWTPDVYEGSPTPVVAFLSVTSKVAASASATRILDIPFYFSSNEWHLLLEILAILSMILGNLLAITQTSMKRMLAYSSIGQIGYVIIGIIVGDSNDGYASMITYMLFYISMNLGTFACIVLFGLRTGTDNIRDYAGLYMKDPFLALSLALCLLSLGGLPPLAGFFGKLYLFWCGWQAGLYFLVSIGLLTSVLSIYYYLKIIKLLMTGRNQEITPYVRNYRRSPLRSNNSIELSMTVCVIASTILGISMNPILAIAQDTLF

SEQ ID NO: 8401 - protein, 492 aa, Unknown
  Sequence found in Organisms: Oryza sativa, Brachypodium distachyon
MKAFHLLLFQGSFIFPECILIFGLILLLMIDLTSDQKDRPWFYFISSTSLVISITALLFRWREEPIISFSGNFQTNNFNEIFQFLILLCSTLCIPLSVEYIECTEMAITEFLLFVLTATLGGMFLCGANDLITIFVAPECFSLCSYLLSGYTKRDLRSNEATMKYLLMGGASSSILVHGFSWLYGSSGGEIELQEIVNGLINTQMYNSPGISIALISITVGLGFKLSPAPFHQWTPDVYEGSPTPVVAFLSVTSKVAASASATRILDIPFYFSSNEWHLLLEILAILSMILGNLLAITQTSMKRMLAYSSIGQIGYVIIGIIVGDSNDGYASMITYMLFYISMNLGTFACIVLFGLRTGTDNIRDYAGLYTKDPFLALSLALCLLSLGGLPPLAGFFGKLYLFWCGWQAGLYFLVSIGLLTSVLSIYYYLKIVKLLMTGRNQEITPYVRNYRRSPLRSNNSIELSMTVCVIASTIPGISMNPILAIAQDTLF

SEQ ID NO: 8402 - protein, 492 aa, Brachypodium distachyon
MKALHLLLFHGSFIFPECILIFGLILLLMIDSTSDQKDRPWFYFISSTSLVISITALLFRWREEPIISFSGNFQTNNFNEIFQFLILLCSTLCIPLSVEYIECTEMAITEFLLFVLTATLGGMFLCGANDLITIFVASECFSLCSYLLSGYTKRDLRSNEATMKYLLMGGASSSILVHGFSWLYGSSGGEIELQEIVNGLINTQMYNSPGISIALISITVGLGFKLSPAPFHQWTPDVYEGSPTPVVAFLSVTSKVAASASATRILDIPFYFSSNEWHLLLEILAILSMILGNLLAITQTSMKRMLAYSSIGQIGYVIIGIIVGDSNDGYASMITYMLFYISMNLGTFACIVLFGLRTGTDNIRDYAGLYTKDPFLALSLALCLLSLGGLPPLAGFFGKLYLFWCGWQAGLYFLVSIGLLTSVLSIYYYLKIIKLLMTGRNQEITPYVRNYRRSPLRSNNSIELSMTVCVIASTIPGISMNPILAIAQDTLF

SEQ ID NO: 8403 - protein, 492 aa, Oryza sativa
MKAFHLLLFQGSFIFPECILIFGLILLLMIDLTSDQKDRPWFYFISSTSLVISITALLFRWREEPIISFSGNFQTNNFNEIFQFLILLCSTLCIPLSVEYIECTEMAITEFLLFVLTATLGGMFLCGANDLITIFVAPECFSLCSYLLSGYTKRDLRSNEATMKYLLMGGASSSILVHGFSWLYGSSGGEIELQEIVNGLINTQMYNSPGISIALISITVGLGFKLSPAPFHQWTPDVYEGSPTPVVAFLSVTSKVAASASATRILDIPFYFSSNEWHLLLEILAVLSMILGNLLAITQTSMKRMLAYSSIGQIGYVIIGIIVGDSNDGYASMITYMLFYISMNLGTFACIVLFGLRTGTDNIRDYAGLYTKDPFLALSLALCLLSLGGLPPLAGFFGKLYLFWCGWQAGLYFLVSIGLLTSVLSIYYYLKIVKLLMTGRNQEITPYVRNYRRSPLRSNNSIELSMTVCVIASTIPGISMNPILAIAQDTLF

SEQ ID NO: 8404 - protein, 492 aa, Oryza sativa
MKAFHLLLFQGSFIFPECILIFGLILLLMIDLTSDQKDRPWFYFISSTSLVISITALLFRWREEPIISFSGNFQTNNFNEIFQFLILLCSTLCIPLSVEYIECTEMAITEFLLFVLTATLGGMFLCGANDLITIFVAPECFSLCSYLLSGYTKRDLRSNEATMKYLLMGGASSSILVHGFSWLYGSSGGEIELQEIVNGLINTQMYNSPGISIALISITVGLGFKLSPAPFHQWTPDVYEGSPTPVVAFLSVTSKVAASASATRILDIPFYFSSNEWHLLLEILAILSMILGNLLAITQTSMKRMLAYSSIGQIGYVIIEIIVGDSNDGYASMITYMLFYISMNLGTFACIVLFGLRTGTDNIRDYAGLYTKDPFLALSLALCLLSLGGLPPLAGFFGKLYLFWCGWQAGLYFLVSIGLLTSVLSIYYYLKIVKLLMTGRNQEITPYVRNYRRSPLRSNNSIELSMTVCVIASTIPGISMNPILAIAQDTLF

SEQ ID NO: 8405 - protein, 492 aa, Lolium multiflorum
MKAFHLLLFNGSFIFPECILIFGLILLLMIDSTSDQKDRPWFYFISSTSLVISITALLFRWREEPIISFSGNFQTNNFNEIFQFLILLCSTLCIPLSVEYIECTEMAITEFLLFILTATLGGMFLCGANDLITIFVAPECFSLCSYLLSGYTKRDLRSNEATMKYLLMGGASSSILVHGFSWLYGSSGGEIELQEIVNGLINTQMYNSPGISIALISITVGLGFKLSPAPFHQWTPDVYEGSPTPVVAFLSVTSKVAASASATRILDIPFYFSSNEWHLLLEILAILSMILGNLLAITQTSMKRMLAYSSIGQIGYVIIGIIVGDSNDGYASMITYMLFYISMNLGTFACIVLFGLRTGTDNIRDYAGLYTKDPFLALSLALCLLSLGGLPPLAGFFGKLYLFWCGWQAGLYFLVSIGLLTSVLSIYYYLKIIKLLMTGRNQEITPYVRNYRRSPLRSNNSIELSMTVCVIASTLPGISMNPILAIAQDTLF

SEQ ID NO: 8406 - protein, 492 aa, Amorphophallus konjac
MKAFHLLLFHGSFIFPECILIFGLILLLMIDLTSDQKDRPWFYFISSTSLVMSITALLFRWREEPMISFSGNFQTNNFNEIFQFLILLCSTLCIPLSVEYIECTEMAITEFLLFVLTATLGGMFLCGANDLITIFVALECFSLCSYLLSGYTKRDVRSNEATMKYLLMGGASSSILVYGFSWLYGLSGGEIELQEIVNGLINTQMYNSPGISIALIFITVGIGFKLSLAPFHQWTPDVYEGSPTPVVAFLSVTSKVAALALATRIFDIPFYFSSNEWHLLLEILAILSMILGNLIAITQTSMKRMLAYSSIGQIGYVIIGIIVGDSNDGYASMITYMLFYISMNLGTFACIVLFGLRTGTDNIRDYAGLYTKDPFLALSLALCLLSLGGLPPLAGFFGKLYLFWCGWQAGLYFLVSIGLLTSVVSIYYYLKIIKLLMTGRNQEITPHVRNYRKSPLRSNNSIELSMTVCVIASTILGISMNPILAIAQDTLF

SEQ ID NO: 8407 - protein, 68 aa, Euonymus alatus
MKAFHLLLLRMEVCIFPECILIFGLILLLMIDLTSDTKRYTLVIFHLFNKFSNEHNSPIVPMERRTYD

SEQ ID NO: 8408 - protein, 492 aa, Ananas comosus
  misc_feature (490)..(490): Xaa can be any naturally occurring amino acid
MKAFHLLLFHGSFIFPECILIFGLILLLMIDSTSDQKDRPWFYFISSTSLVISITALLFRWREEPIISFSGNFQTNNFNEIFQFLILLCSTLCIPLSVEYIECTEMAITEFLLFVLTATLGGMFLCGANDLITIFVAPECFSLCSYLLSGYTKRDVRSNEATMKYLLMGGASSSILVHGFSWLYGSSGGEIELQEIVNGLINTQMYNSPGISIALIFITVGIGFKLSPAPFHQWTPDVYEGSPTPVVAFLSVTSKVAASASATRIFDIPFYFSSNEWHLLLEILAILSMILGNLIAITQTSMKRMLAYSSIGQIGYVIIGIIVGDSNDGYASMITYMLFYISMNLGTFACIVLFGLRTGTDNIRDYAGLYTKDPFLALSSALCLLSLGGLPPLAGFFGKLYLFWCGWQAGLYFLVSIGLLTSVVSIYYYLKIIKLLMTGRNQEITPYVRNYRRSPLRSNNSIELSMTVCVIASTIPGISMNPILAIAQDXLF

SEQ ID NO: 8409 - protein, 413 aa, Glycine max
MKAFHLPLFDGSFIFPECILIFGLILLLMIDSTSDQKDISWFYFISSTSLVMSITALLFRWREEPMISFSGNFQTNNFNEIFQFLILLCSTLCIPLSVEYIECTEMAITEFLLFILTATLGGMFLCGANDLITIFVALECFSLCSYLLSGYTKKDVRSNEATTKYLLMGGASSSILVHGFSWLYGSSGGEIELQEIVNGLINTQMYNSPGILIALLFITVGIGFKLSPAPSHQWTPDVYEGSPTPVVAFLSVTSKVAASASATRIFDIPFYFSSNEWHLLLEILAILSMILGNLIAITQTSMKRMLAYSSIGQIGYVIIGIIVGDSNGGYASMITYMLFYISMNLGTFACIVSFGLRTGTDNIRDYAGLYTKDPYLALSLALCLLSLGGLPPLSGFFGNFIYSGVDGRQAYIS

SEQ ID NO: 8410 - protein, 492 aa, Gossypium hirsutum
MKAFHLLLFDGSFIFPECILIFGLILLLMIDLTSDQKDIPWLYFISSTSLVMSITALLFRWREEPMISFSGNFQTNNFNEIFQFLILLCSTLCIPLSVEYIECTEMAIAEFLLFVLTATLGGMFLCGANDLITIFVALECFSLCSYLLSGYTKKDVRSNEATMKYLLMGGASSSILVYGFSWLYGSSGGEIELQEIVNGLINTQMYNSPGISIALIFITVGIGFKLSLAPFHQWTPDVYEGSPTPVVAFLSVTSKVAASASATRIFDIPFYFSSNEWHLLLEILAILSMILGNLIAITQTSMKRMLAYSSIGQIGYVIIGIIVGDSNGGYASMITYMLFYISMNLGTFACIVLFGLRTGTDNIRDYAGLYTKDPFLALSLALCLLSLGGLPPLAGFFGKLHLFWCGWQAGLYFLVSIGLLTSVVSIYYYLKIIKLLMTGRNQEITPHVRNYRRSPLRSNNSIELSMIVCVIASTIPGISMNPIIAIAQDTLF

SEQ ID NO: 8411 - protein, 492 aa, Gossypium raimondii
MKAFHLLLFDGSFIFPECILIFGLILLLMIDLTSDQKDIPWLYFISSTSLVMSITALLFRWREEPMISFSGNFQTNNFNEIFQFLILLCSTLCIPLSVEYIECTEMAIAEFLLFVLTATLGGMFLCGANDLITIFVALECFSLCSYLLSGYTKKDVRSNEATTKYLLMGGASSSILVYGFSWLYGLSGGEIELQEIVNGLINTQMYNSPGISIALIFITVGIGFKLSLAPSHQWTPDVYEGSPTPVVAFLSVTSKVAALALATRIFDIPFYFSSNEWHLLLEILAILSMILGNLIAITQTSMKRMLAYSSIGQIGYVIIGIIVGDSNGGYASMITYMLFYISMNLGTFACIVLFGLRTGTDNIRDYAGLYTKDPFLALSLALCLLSLGGLPPLAGFFGKLHLFWCGWQAGLYFLVSIGLLTSVVSIYYYLKIIKLLMTGRNQEITPHVRNYRRSPLRSNNSIELSMIVCVIASTIPGISMNPIIAIAQDTLF

SEQ ID NO: 8412 - protein, 492 aa, Eucalyptus grandis
MKAFHLLLFDGSFIFPECILIFGLILLLMIDSTSDQKDIPWFYFISSTSLVMSITALLFRWREEPMIIFSGNFQTNNFNEIFQFLILLCSTLCIPLSVEYIECTEMAITEFLLFVLTATLGGMFLCGANDLITIFVAPECFSLCSYLLSGYTKKDVRSNEATMKYLLMGGASSSILVHGFSWLYGSSGGEIELQEIVNGLINTQMYNSPGILIALLFITVGIGFKLSLAPSHQWTPDVYEGSPTPVVAFLSVTSKVAASASATRIFDIPFYFSSNEWHLLLEILAILSMILGNLIAITQTSMKRMLAYSSIGQIGYVIIGIIVGDSNGGYASMITYMLFYISMNLGTFACIVLFGLRTGTDNIRDYAGLYTKDPFLALSLALCLLSLGGLPPLAGFFGKLHLFWCGWQAGLYFLVSIGLLTSVISIYYYLKIIKLLMTGRNQEITPHVRNYRRSPLRSNNSIELSMIVCVIASTIPGISMNPIIAIAQDTLF

SEQ ID NO: 8413 - protein, 492 aa, Solanum tuberosum
MKAFHLLLFDGSLIFPECILIFGLILLLMIDSTSDQKDIPWLYFISSTSLVLSITALLFRWREEPMISFSGNFQTNNFNEIFQFLILLCSTLCIPLSVEYIECTEMAITEFLLFVLTATLGGMFLCGANDLITIFVAPECFSLCSYLLSGYTKKDVRSNEATMKYLLMGGASSSILVHGFSWLYGSSGGEIELQEIVNGLINTQMYNSPGISIALIFITVGIGFKLSPAPSHQWTPDVYEGSPTPVVAFLSVTSKVAASASATRIFDIPFYFSSNEWHLLLEILAILSMILGNLIAITQTSMKRMLAYSSIGQIGYVIIGIIVGDSNDGYASMITYMLFYISMNLGTFACIVLFGLRTGTDNIRDYAGLYTKDPFLALSLALCLLSLGGLPPLAGFFGKLYLFWCGWQAGLYFLVLIGLLTSVVSIYYYLKIIKLLMTGRNQEITPHVRNYRRSPLRSNNSIELSMIVCVIASTIPGISMNPIIAIAQDSLF

SEQ ID NO: 8414 - protein, 492 aa, Solanum phureja
MKAFHLLLFDGSLIFPECILIFGLILLLMIDSTSDQKDIPWLYFISSTSLVMSITALLFRWREEPMISFSGNFQTNNFNEIFQFLILLCSTLCIPLSVEYIECTEMAITEFLLFVLTATLGGMFLCGANDLITIFVAPECFSLCSYLLSGYTKKDVRSNEATMKYLLMGGASSSILVHGFSWLYGSSGGEIELQEIVNGLINTQMYNSPGISIALIFITVGIGFKLSPAPSHQWTPDVYEGSPTPVVAFLSVTSKVAASASATRIFDIPFYFSSNEWHLLLEILAILSMILGNLIAITQTSMKRMLAYSSIGQIGYVIIGIIVGDSNDGYASMITYMLFYISMNLGTFACIVLFGLRTGTDNIRDYAGLYTKDPFLALSLALCLLSLGGLPPLAGFFGKLYLFWCGWQAGLYFLVLIGLLTSVVSIYYYLKIIKLLMTGRNQEITPHVRNYRRSPLRSNNSIELSMIVCVIASTIPGISMNPIIAIAQDSLF

SEQ ID NO: 8415 - protein, 492 aa, Helianthus annuus
MKAFHLLLFDGSLIFPECILIFGLILLLMIDSTSDQKDIPWLYFISSTSLVMSITALLFRWREEPMISFSGNFQTNNFNEIFQFLILLCSTLCIPLSVEYIECTEMAITEFLLFILTATIGGMFLCGANDLITIFVALECFSLCSYLLSGYTKKDVRSNEATMKYLLMGGASSSILVYGFSWLYGSSGGEIELQEIVNGLINTQMYNSPGISIALIFITVGIGFKLSLAPSHQWTPDVYEGSPTPVVAFLSVTSKVAALALATRIFDIPFYFSSNEWHLLLEILAILSMILGNLIAITQTSMKRMLAYSSIGQIGYVIIGIIVGDSNDGYASMITYMLFYISMNLGTFACIVLFGLRTGTENIRDYAGLYTKDPFLALSLALCLLSLGGLPPLAGFFGKLYLFWCGWQAGLYLLVLIGLLTSVVSIYYYLKIIKLLMTGRNQEITPHVRNYRRSPLRSNNSIELSMIVCVIASTIPGISMNPIIAIAQDTLF

SEQ ID NO: 8416 - protein, 195 aa, Phaseolus coccineus
MKAFHLLLFDGSLIFPECILIFGLILLLMIDLTSDQKDISWFYFISSTSLVMSITALLFRWREEPMIAFSGNLQTNNFNEIFQFLILLCSTLCIPLSVEYIECTEMAITEFLLFILTTTLGGMFLCGANDLITIFVALECFSLCSYLLSGYTKKDVRSNEATTKYLLMGGASSSILVHGFSWLYVRPGERSSFKR

SEQ ID NO: 8417 - protein, 492 aa, Gossypium raimondii
MKAFHLLLFDGSFIFPECILIFGLILLLMIDLTSDQKDIPWLYFISSTSLVMSITALLFRWREEPMISFSGNFQTNNFNEIFQFLILLCSTLCIPLSVEYIECTEMAIAEFLLFVLTATLGGMFLCGANDLITIFVALECFSLCSYLLSGYTKKDVRSNEATMKYLLMGGASSSILVYGFSWLYGLSGGEIELQEIVNGLINTQMYNSPGISIALIFITVGIGFKLSLAPFHQWTPDVYEGSPTPVGTFLFVTSKVAASASATRIFDIPFYFSSNEWHLLLEILAILSMILGNLIAITQTSMKRMLAYSSIGQIGYVIIGIIVGDSNGGYASMITYMLFYISMNLGTFACIVLFGLRTGTDNIRDYAGLYTKDPFLALSLALCLLSLGGLPPLAGFFGKLHLFWCGWQAGLYFLVSIGLLTSVVSIYYYLKIIKLLMTGRNQEITPHVRNYRRSPLRSNNSIELSMIVCVIASTIPGISMNPIIAIAQDTLF

SEQ ID NO: 8418 - protein, 492 aa, Medicago truncatula
MKAFHLLLFDGSFIFPELILIFGLILLLMIDLTSDQKDLSWFYFISSTSLVMSITALLFRWREEPMISFSGNFQTNNFNEIFQFLILLSSTLCIPLSVEYIECTEMAITEFLLFILTATLGGMFLCSANDLITIFVALECFSLCSYLLSGYTKKDVRSNEATMKYLLMGGASSSILVYGFSWLYGSSGGEIELQEIVNGLINTQMYNSPGISIALIFITVGIGFKLSLAPFHQWTPDVYEGSPTPVVAFLSVTSKVAALALATRIFDIPFYFSSNEWHLLLEILAILSMLLGNLIAITQTSMKRMLAYSSIGQIGYVIIGIIVGDSNGGYASMITYMLFYISMNLGTFACIVLFGLRTGTDNIRDYAGLYTKDPFLALSLALCLLSLGGLPPLAGFFGKLYLFWCGWQAGLYFLVSIGLITSVVSIYYYLKIIKLLMTGRNQEITPHVRNYRRSPVRSNNSIELSMIICVIASTILGISMNPIIEIAQDTLF

SEQ ID NO: 8419 - protein, 492 aa, Olea europaea
MKAFHLLLFDGSLIFPECILIFGLILLLMIDSTSDQKDIPWLYFISSTSLVMSITALLFRWREEPMISFSGNFQTNNFNEIFQFLILLCSTLCIPLSVEYIECTEMAITEFLLFVLTATLGGMFLCGANDLITIFVAPECFSLCSYLLSGYTKKDVRSNEATMKYLLMGGASSSILVHGFSWLYGSSGGEIELQEIVNGLINTQMYNSPGISIALIFITVGIGFKLSPAPSHQWTPDVYEGSPTPVVAFLSVTSKVAASASATRIFDIPFYFSSNEWHLLLEILAILSMILGNIIAITQTSMKRMLAYSSIGQIGYVIIGIIVGDSNDGYASMITYMLFYISMNLGTFACIVLFGLRTGTDNIRDYAGLYTKDPFLALSLALCLLSLGGLPPLAGFFGKLYLFWCGWQAGLYSLVLIGLLTSVVSIYYYLKIIKLLMTGRNQEITPHVRNYRRSPLRSNNSIELSMIVCVIASTIPGISMNPIIAIAQDTLF

SEQ ID NO: 8420 - protein, 492 aa, Panax ginseng
MKAFHLLLFDGSLIFPECILIFGLILLLMIDSTSDQKDIPWLYFISSTSLVMSITALLFRWREEPMISFSGNFQTNNFNEIFQFLILLCSTLCIPLSVEYIECTEMAITEFLLFVLTATLGGMFLCGANDLITIFVAPECFSLCSYLLSGYTKKDVRSNEATMKYLLMGGASSSILVHGFSWLYGSSGGEIELQEIVNGLINTQMYNSPGISIALIFITVGIGFKLSPAPSHQWTPDVYEGSPTPVVAFLSVTSKVAASASATRIFDIPFYFSSNEWHLLLEILAILSMILGNLIAITQTSMKRMLAYSSIGQIGYVIIGIIVGDSNDGYASMITYMLFYISMNLGTFACIVLFGLRTGTDNIRDYAGLYTKDPFLALSLALCLLSLGGLPPLAGFFGKLYLFWCGWQAGLYFLVLIGLLTSVVSIYYYLKIIKLLMIGRNQEITPHVRNYRRSPFRSNNSIELSMIVCVIASTIPGISMNPIIAIAQDTLF

SEQ ID NO: 8421 - protein, 492 aa, Prunus persica
MKAFHLLLFDGSFIFPECILIFGLILLLMIDSTSDQKDIPWLYFISSTSLVMSITALLFRWREEPTISFSGNFQTNNFNEIFQFLILLCSTLCIPLSVEYIECTEMAITEFLLFVLTATLGGMFLCGANDLITIFVAPECFSLCSYLLSGYTKKDVRSNEATTKYLLMGGASSSILVHGFSWLYGSSGGEIELQEIVNGLINTQMYNSPGISIALIFITVGIGFKLSPAPSHQWTPDVYEGSPTPVVAFLSVTSKVAASASATRIFDIPFYFSSNEWHLLLEILAILSMILGNLIAITQTSMKRMLAYSSIGQIGYVIIGIIVGDSNGGYASMITYMLFYISMNLGTFACIVLFGLRTGTDNIRDYAGLYTKDPFLALSLALCLLSLGGLPPLAGFFGKLHLFWCGWQAGLYFLVSIGLLTSVVSIYYYLKIIKLLMTGRNQEITPHVRNYRRSPLRSNNSIELSMIVCVIASTIPGISMNPIIEIAQDTLF

SEQ ID NO: 8422 - protein, 492 aa, Guizotia abyssinica
MKAFHLLFFDGSLIFPECILIFGLILLLMIDSTSDQKDIPWLYFISSTSLVMSITALLFRWREEPMISFSGNFQTNNFNEIFQFLILLCSTLCIPLSVEYIECTEMAITEFLLFVLTATIGGMFLCGANDLITIFVAPECFSLCSYLLSGYTKKDVRSNEATMKYLLMGGASSSILVHGFSWLYGSSGGEIELQEIVNGLINTQMYNSPGISIALIFITVGIGFKLSLAPSHQWTPDVYEGSPTPVVAFLSVTSKVAASASATRIFDIPFYFSSNEWHLLLEILAILSMILGNLIAITQTSMKRMLAYSSIGQIGYVIIGIIVGDSNDGYASMITYMLFYISMNLGTFACIVLFGLRTGTENIRDYAGLYTKDPFLALSLALCLLSLGGLPPLAGFFGKLYLFWCGWQAGLYFLVLIGLLTSVVSIYYYLKIIKLLMTGRNQEITPHVRNYRRSPLRSNNSIELSMIVCVIASTIPGISMNPIIAIAQDTLF

SEQ ID NO: 8423 - protein, 492 aa, Amborella trichopoda
MKAFHLLLFHGSFIFPECILIFGLILLLMIDSTSDQKDRPWFYFISSTSLVMSITALLFRWREEPMISFSGNFQTNNFNEIFQFLILLCSTLCIPLSVEYIECTEMAITEFLLFVLTATLGGMFLCGANDLITIFVAPECFSLCSYLLSGYTKRDVRSNEATTKYLLMGGASSSILVHGFSWLYGSSGGEIELQEIVNGLINTQMYNSPGISIALLSITVGIGFKLSPAPFHQWTPDVYEGSPTPVVAFLSVTSKVAASALATRIFDIPFYFSSNEWHLLLEILAILSMILGNLIAITQTSMKRMLAYSSIGQIGYVIIGIIVGDSNDGYASMITYMLFYISMNLGTFARIVSFGPRTGTDNIRDYAGLYTKDPFLALSSALCLLSLGGIPPLAGFFGKLHLFWCGWQAGLYFLVSIGLLTSVVSIYYYLKIIKLLMTGRNKEITPHVRNYRRSPLRSNNSIELSMIVCVIASTIPGISMNPIIAIAQDTFF

SEQ ID NO: 8424 - protein, 492 aa, Vitis vinifera
MKAFHLLLFDGSFIFPECILIFGLILLLMIDSTSDQKDIPWLYFISSTSLVMSITALLFRWREEPMISFSGNFQTNNFNEIFQFLILLCSTLCIPLSVEYIECTEMAITEFLLFVLTATLGGMFLCGANDLITIFVAPECFSLCSYLLSGYTKKDVRSNEATTKYLLMGGASSSILVHGFSWLYGSSGGEIELQEIVNGLINTQMYNSPGISIALIFITVGIGFKLSPAPSHQWTPDVYEGSPTPVVAFLSVTSKVAASASATRIFDIPFYFSSNEWHLLLEILAILSMILGNLIAITQTSMKRMLAYSSIGQIGYVIIGIIVGDSNGGYASMITYMLFYISMNLGTFACIVSFGLRTGTDNIRDYAGLYTKDPFLALSLALCLLSLGGLPPLAGFFGKLHLFWCGWQAGLYFLVSIGLLTSVVSIYYYLKIIKLLMTGRNQEITPHVRNYIRSPLRSNNSIELSMIVCVIASTIPGISMNPIIAIAQDTLF

SEQ ID NO: 8425 - protein, 492 aa, Lactuca sativa
MKAFHLLLFDGSLIFPECILIFGLILLLMIDSTSDQKDIPWLYFISSTSLVMSITSLLFRWREEPMISFSGNFQTNNFNEIFQFLILLCSTLCIPLSVEYIECTEMAITEFLLFVLTATIGGMFLCGANDLITIFVAPECFSLCSYLLSGYTKKDVRSNEATMKYLLMGGASSSILVHGFSWLYGSSGGEIELQEIVNGLINTQMYNSPGISIALIFITVGIGFKLSPAPSHQWTPDVYEGSPTPVVAFLSVTSKVAASASATRIFDIPFYFSSNEWHLLLEILAILSMILGNLIAITQTSMKRMLAYSSIGQIGYVIIGIIVGDSNDGYASMITYMLFYISMNLGTFACIVLFGLRTGTENIRDYAGLYTKDPFLALSLALCLLSLGGLPPLAGFFGKLYLFWCGWQAGLYFLVLIGLLTSVVSIYYYLKIIKLLMTGRNQEITPHVRNYRRSPLRSNNSIELSMIVCVIASTIPGISMNPIIAIAQDTLF

SEQ ID NO: 8426 - protein, 494 aa, Brassica rapa
MKAFHLLLFDGSFIFPECILIFGLILLLMIDSTSDQKDIPWLYFISSTSFVMSITALLFRWREEPMISFSGNFQTNNFNEIFQFLILLCSTLCIPLSVEYIECTEMAITEFLLFVLTATLGGMFLCGANDLITIFVAPECFSLCSYLLSGYTKKDVRSNEATMKYLLMGGASSSILVHGFSWLYGSSGGEIELQEIVNGLINTQMYNSPGISIALIFITVGIGFKLSLAPSHQWTPDVYEGSPTPVVAFLSVTSKVAASALATRIFDIPFYFSSNEWHLLLEILAILSMILGNLIAITQTSMKRMLAYSSIGQIGYVIIGIIVGDSNGGYASMITYMLFYISMNLGTFACIILFGLRTGTDNIRDYAGLYTKDPFLALSLALCLLSLGGLPPLAGFFGKLHLFWCGWRAGLYFLVSIGLLTSVLSIYYYLKIIKLLMTGRNQEITPHVRNYRISPLRSTNSIELSMIVCVIASTIPGISMNPIIAIAQDTLFSF

SEQ ID NO: 8427 - protein, 492 aa, Fagopyrum esculentum
MKAFHLLLFDGSFIFPECILIFGLILLLMIDSTSDQKDIPWFYFISSTSLVMSITALLFRWREEPMISFSGNFQTNNFNEIFQFLILLCSTLCIPLSVEYIECTEMAITEFLLFVLTATLGGMFLCGANDLITIFVAPECFSLCSYLLSGYTKKDVRSNEATTKYLLMGGASSSILVHGFSWLYGSSGGEIELQEIVNGLINTQMYNSPGISIALIFITVGIGFKLSPAPSHQWTPDVYEGSPTPVVAFLSVTSKVAASASATRIFDIPFYFSSNEWRLLLEILAILSMIVGNLIAITQTSMKRMLAYSSIGQIGYVIIGIIVGDSNDGYASMITYMLFYIAMNLGTFACIVSFGLRTGTDNIRDYAGLYTKDPPLALSLALCLLSLGGLPPLAGFFGKLHLFWCGWQAGLYFLVSIGLLTSVVSIYYYLKIIKLLMTGRNQEITPHVRNYRRSPLRSKNSIELSMIVCVIASTILGISMNPIIAIAQDTLF

SEQ ID NO: 8428 - protein, 492 aa, Helianthus annuus
MKAFHLLLFDGSLIFPECILIFGLILLLMIDSTSDQKDIPWLYFISSTSLVMSITALLFRWREEPMISFSGNFQTNNFNEIFQFLILLCSTLCIPLSVEYIECTEMAITEFLLFILTATIGGMFLCGANDLITIFVAPECFSLCSYLLSGYTKKDVRSNEATMKYLLMGGASSSILVHGFSWLYGSSGGEIELQEIVNGLINTQMYNSPGISIALIFITVGIGFKLSPAPSHQWTPDVYEGSPTPVVAFLSVTSKVAASASATRIFDIPFYFSSNEWHLLLEILAILSMILGNLIAITQTSMKRMLAYSSIGQIGYVIIGIIVGDSNDGYASMITYMLFYISMNLGTFACIVLFGLRTGTENIRDYAGLYTKDPFLALSLALCLLSLGGLPPLAGFFGKLYLFWCGWQAGLYLLVLIGLLTSVVSIYYYLKIIKLLMTGRNQEITPHVRNYRRSPLRSNNSIELSMIVCVIASTIPGISMNPIIAIAQDTLF

SEQ ID NO: 8429 - protein, 494 aa, Arabidopsis lyrata
MKAFHLLLFDGSFIFPECILIFGLILLLMIDSTSDQKDIPWLYFISSTSFVMSITALLFRWREEPMISFSGNFQTNNFNEIFQFLILLCSTLCIPLSVEYIECTEMAITEFLLFILTATLGGMFLCGANDLITIFVAPECFSLCSYLLSGYTKKDVRSNEATMKYLLMGGASSSILVHGFSWLYGSSGGEIELQEIVNGLINTQMYNSPGISIALIFITVGIGFKLSLAPSHQWTPDVYEGSPTPVVAFLSVTSKVAASASATRIFDIPFYFSSNEWHLLLEILAILSMILGNLIAITQTSMKRMLAYSSIGQIGYVIIGIIVGDSNGGYASMITYMLFYIAMNLGTFACIILFGLRTGTDNIRDYAGLYTKDPFLALSLALCLLSLGGLPPLAGFFGKLHLFWCGWQAGLYFLVSIGLLTSVLSIYYYLKIIKLLMTGRNQEITPHVRNYRISPLRSNNSIELSMIVCVIASTIPGISMNPIIAIAQDTLFSF

SEQ ID NO: 8430 - protein, 492 aa, Ricinus communis
MKAFHLLLFDGSFIFPECILIFGLILLLMIDSISDQKDIPWLYFISSTSLVMSITALLFRWGEEPMISFSGNFQTNNFNEIFQFLILLCSTLCIPLSVEYIECTEMAITEFLLFVLTATLGGMFLCGANDLITIFVAPECFSLCSYLLSGYTKKDVRSNEATMKYLLMGGASSSILVHAFSWLYGSSGGEIELQEIVNGLINTQMYNSPGISIALIFITVGIGFKLSPAPSHQWTPDVYEGSPTPVVAFLSVTSKVAASASATRIFDIPFYFSSNEWHLLLEILAILSMIVGNLIAITQTSMKRMLAYSSIGQIGYVIIGIIVGDSNGGYASMITYMLFYISMNLGTFACIVLFGLRTGTDNIRDYAGLYTKDPFLALSLALCLLSLGGLPPLAGFFGKLHLFWCGWQAGLYFLVLIGLLTSVVSIYYYLKIIKLLMTGRNQEITPHVRNYRRSPLRSNNSIELSMIVCVIASTIPGISMNPIIEIAQDTLF

SEQ ID NO: 8431 - protein, 494 aa, Arabidopsis thaliana
MKAFHLLLFDGSFIFPECILIFGLILLLMIDSTSDQKDIPWLYFISSTSFVMSITALLFRWREEPMISFSGNFQTNNFNEIFQFLILLCSTLCIPLSVEYIECTEMAITEFLLFILTATLGGMFLCGANDLITIFVAPECFSLCSYLLSGYTKKDIRSNEATMKYLLMGGASSSILVHGFSWLYGSSGGEIELQEIVNGLINTQMYNSPGISIALIFITVGIGFKLSLAPSHQWTPDVYEGSPTPVVAFLSVTSKVAASASATRIFDIPFYFSSNEWHLLLEILAILSMIFGNLIAITQTSMKRMLAYSSIGQIGYVIIGIIVGDSNGGYASMITYMLFYIAMNLGTFACIILFGLRTGTDNIRDYAGLYTKDPFLALSLALCLLSLGGLPPLAGFFGKLHLFWCGWQAGLYFLVSIGLLTSVLSIYYYLKIIKLLMTGRNQEITPHMRNYRISPLRSNNSIELSMIVCVIASTIPGISMNPIIAIAQDTLFSF

SEQ ID NO: 8432 - protein, 494 aa, Brassica napus
MKAFHLLLFDGSFIFPECILIFGLILLLMIDSTSDQKDIPWLYFISSTSFVMSITALLFRWREEPMISFSGNFQTNNFNEIFQFLILLCSTLCIPLSVEYIECTEMAITEFLLFVLTATLGGMFLCGANDLITIFVAPECFSLCSYLLSGYTKKDVRSNEATMKYLLMGGTSSSIPVHGFSWLYGSSGGEIEHQEIVNGLINIQMYNSPGISIALIFITVGIGFKLSLAPSHQWTPDVYEGSPTPVVAFLSVTSKVAASALATRIFDIPFYFSSNEWHLLLEILAILSMILGNLIAITQTSMKRMLAYSSIGQIGYVIIGIIVGDSNGGYASMITYMLFYISMNLGTFACIILFGLRTGTDNIRDYAGLYTKDPFLALSLALCLLSLGGLPPLAGFFGKLHLFWCGWRAGLYFLVSIGLLTSVLSIYYYLKIIKLLMTGRNQEITPHVRNYRISPLRSTNSIELSMIVCVIASTIPGISMNPIIAIAQDTLFSF

SEQ ID NO: 8433 - protein, 492 aa, Cicer arietinum
MKAFHLLLFDGSFIFPEFILIFGLILLLMIDSTSDQKNISSFYFISSTSLVMSITALLFRWREEPMISFSGNFQTNNFNEIFQFLILLSSTLCIPLSVEYIECTEMAIPEFLLFILTATLGGMFLCSANDLITIFVALECFSLCSYLLSGYTKKDVRSNEATMKYLLMGGASSSILVHGFSWLYGSSGGEIELQEIVNGLINTQMYNSPGISIALIFITVGIGFKLSLAPSHQWTPDVYEGSPTPVVAFLSVTSKVAALASATRILDIPLYFSSNEWHLLLEILAILSMILGNFIAITQTSMKRMLAYSSIGQIGYVIIGIIVGDSNGGYASMITYMLFYIAMNLGTFACIVSFGLRTGTDNIRDYAGLYTKDPFLAVSLALCLLSLGGLPPLAGFFGKLYLFWCGWQAGLYFLVSIGLLTSVVSIYYYLKIIKLVMTGRNQEITTYVRNYRRSPVRSNNSIELSMIICVIASTIPGISMNPIIEIAQDTLF

SEQ ID NO: 8434 - protein, 490 aa, Jatropha curcas
MKAFHLLLFDGSFIFPECILIFGLILLLMIDSTSDQKDIPWLYFISSTSLVMSITALLFRWREEPMISFSGNFQTNNFNEIFQFLILLCSTLCIPLSVEYIECTEMAITEFLLFLLTATLGGMFLCGANDLITIFVAPECFSLCSYLLSGYTKKDVRSNEATTKYLLMGGASSSILVHAFSWLYGSSGGEIELQEIVNGLINTQMYNSPGISIALIFITVGIGFKLSPAPSHQWTPDVYEGSPTPVVAFLSVTSKVAASASATRIFDIPFYFSSNEWHLLLEILAFLSMIVGNLIAITQTSMKRMLAYSSIGQIGYVIIGIIVGDSNGGYASMITYMLFYISMNLGTFACIVLFGLRTGTDNIRDYAGLYTKDPFLALSLALCLLSLGGLPPLAGFFGKLHLFWCGWQAGLYFLVLIGLLTSVVSIYYYLKIIKLLMTGRNQERTSHVRNYRTLRSNNSIELSMIVCVIASTIPGISMNPIIEIAQDTLF

SEQ ID NO: 8435 - protein, 493 aa, Pisum sativum
MKAFHLLIFDGSFLFPELILILGLILLLMIDSTLDQKEISWFYFISSTSFVMSITALLFRWREEPMISFSGNFQTNNFNEIFQFLILLSSTLCIPLSVEYIECTEMAITEFLLFILTATLGGMVLCSANDLITIFVALECFSLCSYLLSGYTKKDVRSNEATMKYLLMSGASSSILVHGFSWLYGSSGGEIELQEIVNGLINTQMYNSPGISIALIFITVGIGFKLSPAPSHQWTPDVYEGSPTPVVAFLSVTSKVAASASATRILDIPFYFSSNEWHLLLEILAILSMILGNLIAITQTSMKRMLAYSSIGQIGYVIIGIIVGDSNGGYASMITYMLFYISMNLGTFACIVLFGLRTGTDNIRDYAGLYTKDPFLALSLALCLLSLGGLPPLAGFFGKLSLFWCGWQAGRYFLVSIGLLTSVVSIYYYLKIMKLLMTGRNQEITPHVRNYRRFPVRSNNSIELSMIICVIASTILGISMNPIIEIAQEYPFL

SEQ ID NO: 8436 - protein, 467 aa, Liriodendron tulipifera
MKAFHLLLFHGSFIFPECILIFGLILLLMIDSTSDQKDIPWLYFISSTSLVMSITALLFRWREEPMISFSGNFQTNNFNEIFQFLILLCSTLCIPLSVEYIECTEMAITEFLLFVLTATLGGMFLCGANDSITIFVAPECFSLCSYLLSGYTKRDVRSNEATTKYLLMGGASSSILVHGFSWLYGSSGGEIELQEIVNGLIKTQMYNSPGISIALIFITVGIGFKLSPAPSHQWTPDVYEGSPTPVVAFLSVTSKVAASASATRIFDIPFYFSSNEWHLLLEILAILSMILGNLIAITQTSMKRMLAYSSIGQIGYVIIGIIVGDSNDGYASMITYMLFYISMNLGTFARIVSFGLRTGTDNIRDYAGLYTKDPFLALSSALCLLSLGGLPPLAGFFGKLHLFWCGWQAGLYFLVSIGLLTSVVSIYYYLKIIKLLMTGRNQEITPHVRNYRRSPLRSNNSIELSMI

SEQ ID NO: 8437 - protein, 464 aa, Phaseolus coccineus
MIDSTSDQKDISWFYFISSTSLVMSITALLFRWREEPMIAFSGNLQTNNFNEIFQFLILLCSTLCIPLSVEYIECTEMAITEFLLFILTTTLGGMFLCGANDLITIFVALECFSLCSYLLSGYTKKDVRSNEATTKYLLMGGASSSILVHGFSWLYGSSGGEIELQEIVNGLINTQMYNSPGILIALLFITVGIGFKLSPAPSHQWTPDVYEGSPTPVVAFLSVTSKVAASASATRIFDIPFYFSSNEWHLLLEILAILSMILGNLIAITQTSMKRMLAYSSIGQIGYVIIGIIVGDSNGGYASMITYMLFYISMNLGTFACIVSFGLRTGTDNIRDYAGLYTKDPYLALSLALCLLSLGGLPPLAGFFGKLHLFWCGWQAGLYFLVSIGLLTSVVSIYYYLKIIKLLMTGRNQEITPHVRNYRRSPFRSNNSIEFSMIVCVIASTIPGISMNPIIEIAQDTLF

SEQ ID NO: 8438 - protein, 494 aa, Zamia vazquezii
  misc_feature (157)..(157): Xaa can be any naturally occurring amino acid
MKEFHLLLFHGGSILPECILILGLILLLMIDLTSDQKDTPWLYFISLTSLVMSITVLLFRWREEPTISFLGNFQTSNFNKIFRFLILLCSTLCIPLSVEYIKCAEMAITEFLLFLLTAALGGMVLCGANDLVTIFVALECFSLCSYLLSGYTKRDVXSNEATMKYLLMGGASSSILVYGFSWLYGLSGGEIELQEVVNGLINTQMYNSPGILIALISITVGIGFKLSLVPFHQWTPDVYEGSPTPVVAFLSVTSKVAASALATRIFDIIFYFSSNEWHLLLEILAILSMILGNLIAITQTSMKRMLAYSSMGQIGYIIIGIIAGDSKNGYASMITYMLFYIFMNLGTFACIVLFGLRTGTDNIRDYAGLYTKDPFSAFSLALCLLSLGGIPPLAGFFGKLYLFWCGWQAGLYLLVSIGPFMSVISIYYYLKIIKLLMTERNKEITPHVQNYRGSPSSFISKNSIELSMIVCVTASTTLGIAMNPIIAIAQDTLF

SEQ ID NO: 8439 - protein, 492 aa, Pinus taeda
MKEYHLLLFYGSSIFPECILIFGLFLLLVIDVIFDKKKTTWFYFISLTSLVLSIAFLLFQWREEPTIIFFGNLQTNNFNKVFRFLILLCSTLCIPLSVEYIQCTEMAVTEFLLFILTATLGGMFLCGANDLTTIFVSLECLSLCSYLLSGYTKRDIRSNEAIMKYLLMGGTSSSILAYGLSWLYGLSGGEIEIQEIANGLINTQMYNSPGIWIALLSVTVGIAFKLSLVPFHQWTPDVYEGSPTPVVAFISVISKVAASALVTRIFDIIFYFSLNEWHLLLEILAILSMIVGNLIAITQTSMKRMLAYSSIGQIGYVIIGIIVGDSNGGYASMITYMLFYISMNLGTFACIVLFGLRTGTDNIRDYAGLYTKDPFLALSLALCLLSLGGLPPLAGFFGKLHLFWCGWQAGLYFLVSIGLLTSVLSIYYYLKIIKLLMTGQNQEITPHVRNYRGSPLRSNNSIELSMIVCVIASTIPGISMSPIIEIAQDTLF

SEQ ID NO: 8440 - protein, 307 aa, Sorghum bicolor
MAQDDPVVSPQWLHEHLGMPDVKVLDASWYMPVENRDPWEEYQVAHIPGALFFDLDGIVDPTTDLPHMLPSEEAFAAAISELDIKNQDKVIIYDGKGFFSAPRVWWMFRVFGHTKVWVLDGGLPLWRASGFNVENVSSGDAVLKSNAANKAVERVYNGEQTNTITFHTEFQPNLFWSLEKVAHNVTAKTYQQIDARAKGRFDGVAPEPRKGVRSGHIPGSICVPFPEMFDGAPSLLSADELRQKFQQAGISLDQPIVVTCGSGVTACILALGLYRIGRHDVPVYDGSWTEWEAQSDSDYPKITAPAC

SEQ ID NO: 8441 - protein, 307 aa, Panicum virgatum
MAQDDPVVSAQWLHLHLGAPDVKVLDASWYMLVENRDPWEEYQVAHIPGALFFNIDGIVDQKTDLPHMLPSEEAFAAAVSALDIKNQDKVIVYDGKGFFSAPRVWWMFRVFGHNKVWVLDGGLPQWRASGFDLGSANPDDAVLKSKTANKAVERVYNGELTNTIAFKTEFQPHLYWTLEKVAHNVAAKNYQQVDARSKGRFDGVAPEPREGVRSGHIPGSRCVPFPEMFDGAPRLLSADELRKKFQQAGISLDHPIVVSCGSGVTACILALGLYRIGKHDVPVYDGSWTEWEAQSDSDYPKATATAA

SEQ ID NO: 8442 - protein, 306 aa, Setaria italica
MAQDDPVVSAQWLHQHLGAPDVKVLDASWYMPVENRNPWEEYQVAHIPGAVFFDIDAIVDRTTDLPHMLPSEEAFAAAVSALDIKNQDKVIVYDGKGFFSAPRVWWMFRVFGHNKVWVLDGGLPQWRASGFDLGSASPDDAVLKSKAASKAVERVYNSEPTNIITFQTEFQPRLLWTLEKVAHNVAAKTYQQVDARSKGRFDGVAPEPREGVRSGHIPGSKCVPFPEMFDGAPRLLSTDELRQKFQQAGISLDHPIVVSCGSGVTACILALGLYRIGKHNVPVYDGSWTEWEAQSDSHYPKATTTA

SEQ ID NO: 8443 - protein, 307 aa, Panicum virgatum
MAQDDSVVSAQWLHQHLGAPDVKVLDASWYMPVENRDPWEEYQVAHIPGALFFDIDGIVDQTTDLPHMLPSEEAFAAAVSALDIKNQDKVIVYDGKGFFSAPRVWWMFRVFGHNKVWVLDGGLPQWRASGFDLGSANPDDAVVKSKTANKAVERVYNGELTNTITFKTEFQPHLYWTLEKVAHNVAAKNYQQVDARSKGRFDGVAPEPREGVRSGHIPGSKCVPFPEMFDGAPRLLSAEELRQKFQQAGISLDHPIVVSCGSGVTACILALGLYRIGKHDVPVYDGSWTEWEAQSDSDYPIATTAAA

SEQ ID NO: 8444 - protein, 305 aa, Cenchrus ciliaris
  misc_feature (242)..(242): Xaa can be any naturally occurring amino acid
  misc_feature (251)..(251): Xaa can be any naturally occurring amino acid
  misc_feature (254)..(254): Xaa can be any naturally occurring amino acid
MAQDDPVVSAEWLHQHLGAPDVKVLDASWYMPVENRNPWEEYQVAHIPGAVFFDIDGIVDRTTDLPHMLPSEEAFAAAVTALDIKNQDKVIVYDGKGFFSAPRVWWMFRVFGHNKVWVLDGGLPQWRASGFDLGSASPEAVLKSKAASKAVERVYNSEPTNIITFQTEFQPHLLWTLEKVAHNVTAKTFQQVDARSKARFDGVAPEPREGVRSGHIPGSKCVPFPEMFDGAPRLLSTDELSXKFQQAGISXDHXIVVSCGSGVTACILALGLYRIGKHNVPVYDGSWTEWEAQSDSDYPKAATTA

SEQ ID NO: 8445 - protein, 307 aa, Avena sativa
MAQDDPVVSAQWLQQRLGQPDIKVLDASWYMPQESRDPWQEYQVAHIPGALFFDIDGIVDRTTDLPHMLPSEEAFAAAVSALGIKNTDKVIVYDGKGFFSAPRVWWMFRVLGHNEVWVLDGGLPQWRASGFNLGSNCPDDILLKSKAANIAVETAYNGELTNAATFQTEFQPQLFWTLEKVKNNVAAQAHQVVDARAKGRFDGVAPEPREGVRSGHIPGTKCVPFPEMFDGAPMLLPADELSKKFEEAGISLDHPIAVTCGSGVTACIVALGLYRIGKHDVPVYDGSWTEWEAQPDSDYPKVTSTAS

SEQ ID NO: 8446 - protein, 377 aa, Sorghum bicolor
MESEEGATVVCAHAHQEEAAAAAEAAAAMKEAGGGGKRRRKQQRKQGGGGGGRKKYALVSYHELPEYMKENEFILNYYRSEWPILNAVLSLFSWHNETINIWTHLLGFMLFFGLTLVHLGQYFPQVADLIGHLSWPISKVAENVSSNIGDVLSGAAMFIQTNPTLVSYGAAVTSQTTRWPFFVFLAGAMFCLLSSSACHLLSCHSHSLNLFLIRLDYTGIAVMIVVSFFPPIYYIFQCEPHWQVVYLSAITAAGVGTVYALMSPRLSAARYRAHRALLFVGMGLSGVVPAVHAAAVNWHEPARNVTLAYEGAMAVSYLVGTAFYLTRVPERWRPGAFDLAGHSHQIFHALVIAGALAHYGAAIVFLKARDEMGCPAS

SEQ ID NO: 8447 - protein, 370 aa, Setaria italica
MESSEEGATLCGHQEAAAAAAAVKGGGGGKRRKKGQRRGGEAGGERKKYKLVSYHELPDYMKENEFILNYYRSEWPILNAVLSLFSWHNETINIWTHLLGFMLFFGLTLVHLGQYFPQVADLIGHLSWPISKVAENVSSNIGDVLSGAAMFIQTNPTLASYGTAVASQTTRWPFFVFLAGAMFCLLSSSACHLLSCHSHRLNLFLIRLDYTGIAVMIVVSFFPPIYYIFQCEPRWQAVYLSAITAAGVGTVYALMSPRLSAARYRAHRALLFVGMGLSGVVPAAHAAAVNWHEPARNVTLAYEGAMAASYLVGTAFYLSRVPERWRPGAFDLAGHSHQIFHALVIAGALAHYGAAIVFLKARDEMGCPAK

SEQ ID NO: 8448 - protein, 371 aa, Pennisetum glaucum
MESSEKGATPCGHQEPAAAAAAAAVKGGGGKRRRKGQRRGAEAGGERRKYKLVSYQELPDYMKENEFILNYYRSEWPILNAVLSLFSWHNETINIWTHLLGFMLFFGLTLVHLGQYFPQVADLIGHLSWPISKVAENVSSNIGDVLSGAAMFIQTNPTLASYGTAVALQTTRWPFFVFLAGAMFCLLSSSACHLLSCHSHRLNLFLIRLDYTGIAVMIVVSFFPPIYYIFQCEPRWQAVYLSAITAAGVGTVYALMSPRLSAARYRAHRALLFVGMGLSGVVPAAHAMAVNWHEPARNVTLAYEGAMAASYLVGTAFYLSRVPERWRPGAFDLAGHSHQIFHALVIAGALAHYGAAIVFIKARDEMGCPAK

SEQ ID NO: 8449 - protein, 238 aa, Panicum virgatum
  misc_feature (230)..(230): Xaa can be any naturally occurring amino acid
  misc_feature (235)..(235): Xaa can be any naturally occurring amino acid
MGQQQQVVIVGEEHCGGEDRELTVRKTTLFTPGDGLEAYDHRTGALAFRVETYGRGGACGGGAAAGDLALLDAEGEPVLTVRRRRPSLHNRWDGFLGDGAAAGGGGHQKPLFSARRSSILGAGTGAAAVLVDLLAPGATGEFHVDGSFPRRCCRVVASARAWGGADGEAEEDVVVAEVRRKVDEDAHVVMGRDVFVLWVRAGFDAAFAMGIVLVLDRITGDEVDGDLGEXPLEAXSPA

SEQ ID NO: 8450 - protein, 237 aa, Setaria italica
MGQQQVVIVGEEHCGGEDRKLTVRKTTLFKPGDGLEAYDHRTGALAFRVETYGRGGECGGGAAAGDLALLDAEGEPVLTVRRHRPSLHNRWDGFLGDGGAGHGHQKPLFSARRSSILGHGTGAAAVLVDLLAPGATGEFHVDGSFPRRCCRVVASKAWGASEGGGKEEEEDVVVAEVRRKVDEDAHVVMGRDVFVLWVRAGFDAAFAMGIVLVLDRITGDEVDGDLGEDLFEATSPA

SEQ ID NO: 8451 - protein, 617 aa, Sorghum bicolor
MSGAALCAALTELGFDGEDPLDADALEWPFQYEEARPLLAWICSCLRPSNVLSPSHLAQYEQLVEEGRLLEGEDLDSAFDSISAFSSKKDNQEAVFGLEETILDIREAKLAYRAEVFELQKQLARQQAQFDLLAGQASTLIQGRRARVSAMSAVSGELISLDEILSSRNLEMNAVLGRIAATTQELAHYHSGDEESIYLAYSDFHPYVVGDLSCTKELNRWFSKQFEKGPFRLVAEEGKSKCSWVSLDDITNCLIRGDSEKSHHHQRVAELQRLRSIFATSERQWIEAQVENAKQQAILSILKAQVSSDEAHIHRDIHSLRRKGSELAGELSTLSQKVQALVSETIPCLCSELAQLQGTYILQGDYDLKVMRQEYYINRQKTFINHLVNQLARHQFLKIACQLERKNIARAYSLLRVIESELQSYLSAVNTRLGHYNSLIQAASEVREQGAIDDRDTFLHAVRDLLCIHSNVQATVPTYMSAHALVQQISALQSDLLSLQSELENTLPADRKRCINELCTLIQTVEQLLFASSTTAEPILTPWPLMRALDDMENANAQVEVSVEEVTKARTQKIKIFENRAHEVGRERQIFVDFFCNPERLKNQVRELTSRVKALQD

SEQ ID NO: 8452 - protein, 617 aa, Setaria italica
MSGAALCAALTELGFDGEDPLDADALEWPFQYEEARPLLAWICSCLRPSNVLSPSHLAQYEQLVEEGRLLEGEDLDSAFDSISAFSSKKDNQEAVFGSEETILDIREAKLAYRAEVFELQKQLARQQAQFDLLAGQASTLIQGRRARVSAMSAVSGELVSLDEILSSRNLEMNAVLGRIAATTQELAHYHSGDEESIYLAYSDFHPYVVGDLACTKQLNKWFSKQFEKGPFRLVAEEGKSKCSWVSLDDITNCLIRGDSEKSHHHQRVAELQRLRSIFATSERQWIEAQVENAKQQAILSILKAQVSSDEAHIHRDIHSLRRKGSELAGELSTLSQKVQAFVSETIPCLCSELAQLQGTYILQGDYDLKVMRQEYYINRQKTFINHLVNQLARHQFLKIACQLERKNIASAYSLLRVIESELQSYLSAVNTRLGHYNSLIQAASDVREQGAIDDRDTFLHAVRDLLCIHSNVQATVPTYMSAHALVQQISALQSDLLSLQSELENTLPADRKRFINELCTLIQTVEQLLFASSTTAEPILTPWPLMRALDDMENANAQVEVSVEEVTKARTQKIKIFENRAHEVGRERQIFVDFFCNPERLKNQVRELTSRVKALQD

SEQ ID NO: 8453 - protein, 617 aa, Panicum virgatum
MSGAALCAALTELGFDGEDPLDADALEWPFQYEEARPLLAWICSCLRPSNVLSLSHLAQYEQLVEEGRLLEGEDLDSAFDSISAFSSKKDNQEAVFGSEETILDIRKAKLAYRAEVFELQKQLTRQQAQFDLLAGQASTLIQGRRARLSAMSTVSGQLLSLDEILSSRNLEMNAVLGRIATTTQELAHYHSGDEESIYLAYSDFHPYVVGDLACTKELNRWFSKQFEKGPFRLVAEEGKSKCSWVSLDDITNCLMRGDSEKSHHHQRVAELQRLRSIFATSERQWIEGQVENAKQQAILSILKSQVSSDEAHIHRDIHSLRRKGSELAGELSTLSQKVQAFLSETIPCLCSELAQLQGTYILQGDYDLKVMRQEYYINRQKTFINHLVNQLARHQFLKIACQLERKNIASAYSLLRVIESELQSYLSAVNTRLGHYNSLIQAASEVREQGAIDDRDTFLHAARDLLCIHSNVQATVPTYMSAHALVQQISALQSDLLSLQSELENTLPADRKRCINELCTLIQTVEQLLFASSTTAEPILTPWPLMRALDDMENANAQVEVSVEEVTKARTQKIKIFENRAHEVGRERQIFIDFFCNPERLKNQVRELTSRVKALQD

SEQ ID NO: 8454 - protein, 617 aa, Oryza sativa
MSGAALCAALTELGFDGEDPLDADALEWPFQYEEARPLLAWICSCLRPSNVLSPSHLAQYEQLVEEGRLLEGEDLDSAFDSISAFSSKKDNQEAVFGSEETILDIREEKLAYRAEVFELQKQLARQQAQFDLLAGQASTLIQGRRARVTAMSAVSGQLISLDEQLSSRNLEMNAVLGRITATTQELAHYHSGDDESIYLAYSDFHPYVVGDLACTKELNRWFSKQFEKGPFRLVAEEGKSKCSWVSLDDITNGLIRGDSEKSHHHQRVAELQRLRSIFATSERQWIEAQVENAKQQAILSILKSQVSSDEAHIHRDIHSLRRKGSELAGELSTLSQKVQAFVSETIPCLCSELAQLQGTYILQGDYDLKVMRQEYYINRQKTFISHLANQLARHQFLKIACQLERKNIASAYSLLRVIESELQSYLSAVNTRLGHCTSLIQAATEVREQGAIDDRDTLLHAVRDLLCVHSNVQATMPTYMSAHALVQQISALQSDLLSLQSELESALPADRKRCINELCTLIQTVEQLLFASSTTAEPILTPWPLMRALDDMENANAQVEVSVEEVTKARTQKIKIFENRAHEVGRERQVFVDFFSNPERLKNQVRELTSRVKALQE

SEQ ID NO: 8455 - protein, 617 aa, Brachypodium distachyon
MSGAALCAVLTELGFDGEDPLDADALEWPFQYEEARPLLAWICSCLRPSNVLSPSHLSQYEQLVEEGRLLEGEDLDSAFDSISAFSSKKDNQEAVFEAEETILDIREAKVAYRAEVFELQKQLARQQAQFDLLSGQASSLIQGRRARVSAMSTVNVQLISLDEILSSRNIEMNAVLGRIAATTQELAHYHSGDEDSIYLAYSDFNPYVIGDLACTKELNRWFSKQFEKGPFRLVAEEGKSKCSWVSLDDITNCLARGDSEKSHHHQRVAELQRLRSIFATSERQWVEAQVENAKQQAILSILKSQVSSDEAHIHRDIHSLRRKSSELAGELSTLSQKVQAFVSETIPCLCSELAQLQGTYILQGDYDLKVMRQEYYINRQKTFINHLVNQLSKHQFLKIACQLERKHIASAYSLLRVIESELQSYLTAVNTRLGHYNSLIQAASEVREQGAIDDRDTFLHAVRDLLCIHSNAQAAVPTYMSAHALVQQISALQSDLLSLQSELENTLPADRKRCINELCTLIQTVEQLLFASSTTAEPVLTPWPLMRALDDMENANAQVEVSVEEVTKARTQKIKIFENRAHEVGRERQVFVDFFSNHERLKNQVRELTSRVKALQE

SEQ ID NO: 8456 - protein, 569 aa, Sorghum bicolor
MSGAALCAALTELGFDGEDPLDADALEWPFQYEEARPLLAWICSCLRPSNVLSPSHLAQYEQLVEEGRLLEGEDLDSAFDSISAFSSKKDNQEAVFGLEETILDIREAKLAYRAEVFELQKQLARQQAQFDLLAGQASTLIQGRRARVSAMSAVSGELISLDEILSSRNLEMNAVLGRIAATTQELAHYHSGDEESIYLAYSDFHPYVVGDLSCTKELNRWFSKQFEKGPFRLVAEEGKSKCSWVSLDDITNCLIRGDSEKSHHHQRVAELQRLRSIFATSERQWIEAQVENAKQQAILSILKAQVSSDEAHIHRDIHSLRRKGSELAGELSTLSQKVQALVSETIPCLCSELAQLQGTYILQGDYDLKVMRQEYYINRQKTCLQGHYNSLIQAASEVREQGAIDDRDTFLHAVRDLLCIHSNVQATVPTYMSAHALVQQISALQSDLLSLQSELENTLPADRKRCINELCTLIQTVEQLLFASSTTAEPILTPWPLMRALDDMENANAQVEVSVEEVTKARTQKIKIFENRAHEVGRERQIFVDFFCNPERLKNQVRELTSRVKALQD

SEQ ID NO: 8457 - protein, 631 aa, Oryza sativa
MSGAALCAALTELGFDGEDPLDADALEWPFQYEEARPLLAWICSCLRPSNVLSPSHLAQYEQLVEEGRLLEGEDLDSAFDSISAFSSKKDNQEAVFGSEETILDIREEKLAYRAEVFELQKQLARQQAQFDLLAGQASTLIQGRRARVTAMSAVSGQLISLDEQLSSRNLEMNAVLGRITATTQELAHYHSGDDESIYLAYSDFHPYVVGDLACTKELNRWFSKQFEKGPFRLVAEEGKSKCSWVSLDDITNGLIRGDSEKSHHHQRVAELQRLRSIFATSERQWIEAQVENAKQQAILSILKSQVSSDEAHIHRDIHSLRRKGSELAGELSTLSQKVQAFVSETIPCLCSELAQLQGTYILQGDYDLKVMRQEYYINRQKTFISHLANQLARHQFLKIACQLERKNIASAYSLLRVIESELQSYLSAVNTRLGHCTSLIQAATEVREQGAIDDRDTLLHAVRDLLCVHSNVQATMPTYMSAHALVQQISALQSDLLSLQSELESALPADRKRCINELVSSDLSKPTHILGLVNRTVVSHVVKAVRHPNSWQSIGSMPLMRALDDMENANAQVEVSVEEVTKARTQKIKIFENRAHEVGRERQVFVDFFSNPERLKNQVRELTSRVKALQE

SEQ ID NO: 8458 - protein, 637 aa, Sorghum bicolor
MAKEYPASPKAQQLQESKKQRLTYILVVSALCIAFYVLGAWQNTTLPKPIGNSGITRVGCDPTTASTTQSSGSVPSFGPGSGEVLDFDAHHRLTINNTDGDGELQQFPACPLNFSEYTPCEDRKRGRRFDRAMLVYRERHCPGKDEQVRCLIPAPPGYRTPFKWPHSRDYAYFNNIPHKELSIEKAVQNWIQVEGDKFKFPGGGTMFPRGADAYIDDIDKLISLSDGKIRTAVDTGCGVASWGAYLLKRNIIAMSFAPRDTHEAQVQFALERGVPAIIGVMGKHRLPYPSRAFDMAHCSRCLIPWYEHDGLYLAEVDRILRPGGYWILSGPPINWKTHHVGWERTKDDLKQEQDNIEDIARSLCWNKVVEKRDLSIWQKPKNHLECANIKKTYKTPHICKSDNPDAAWYRQMEACVTPLPEVSNQGEVAGGAVEKWPERAFLVPPRIRRGMIPGLDAKKFDEDKKLWEKRVAYYKRIIPIAENRYRNVMDMNANMGGFAASLVKYPVWVMNVVPVNSDRDTLGAIYERGFIGTYQDWCEAFSTYPRTYDLLHADNLFSIYQDRCDITDILLEMDRILRPEGTAIIRDTVDVLTKVQAITKRMRWESRIMDHEDGPFNPEKVLMAVKTYWTAKTEEEH

SEQ ID NO: 8459 - protein, 638 aa, Pennisetum glaucum
MPKEYPASPKAQQLQESKKQRLTYILVVSALCITFYVLGAWQNTTLPKPVGNSAITRVGCDPATTTQSSSSASVPSFGPGSGEVLDFDAHHRLTINDTDADVGLQQFPACPLNFSEYTPCEDRTRGRRFDRAMLVYRERHCPGKDEQVRCLIPAPPGYRTPFKWPKSRDYAYFNNIPHKELSIEKAVQNWIQVEGDKFRFPGGGTMFPRGADAYIDDINKLIPLSDGHIRTAVDTGCGVASWGAYLLKRNIIAMSFAPRDTHEAQVQFALERGVPAILGVMGKHRLPYPSRAFDMAHCSRCLIPWYAHDGLYLAEVDRILRPGGYWILSGPPINWKTHHNGWERTKDDLKQEQDNIEDVARSLCWKKVIEKGDLSIWQKPKNHLECANIKKTYKTPHICKSDNPDAAWYRQMEACVTPLPEVSNQGEVAGGAVEKWPDRAFIVPPRIRRGMIPGLDSKKFDEDKKLWEKRIAYYKRTIPIAENRYRNVMDMNANMGGFAASLVKYPVWVMNVVPVNSDRDTLGAIYERGFIGTYQDWCEAFSTYPRTYDLLHADNLFSIYQDRCDITDILLEMDRILRPEGTAIIRDTVDVLTKVQAITKRMRWESRILDHEDGPFNPEKVLMAVKTYWTAEAPEDQH

SEQ ID NO: 8460 - protein, 631 aa, Secale cereale
MAKDYPASPKAQHLQESKKQRLTYVLVVSALCVAFYVLGAWQNTTMPNTVADSAISRVDCDTVAQRDGSVPSFAPASENVLDFDAHHQLNLSDTESAVQQFPACSLNQSEYTPCEDRKRGRLFDRDMLIYRERHCPGKDEQIRCLIPAPPKYKNPFRWPESRDVAWFDNIPHKELSIEKAVQNWIRVEGNKFRFPGGGTMFPHGADAYIDDISKLISLSDGRIRTAIDTGCGVASFGAYLLKRDIITMSFAPRDTHEAQVQFALERGVPAILGVMGSLRLPYPSRAFDLAHCSRCLIPWGGHDGLYLAEIDRILRPGGYWIHSGPPINWKTHHNGWQRTEEDLKREQDKIEDVARSLCWNKVAEKEDLSIWQKPKNHLECADIKKKYKMPHICKSDNPDAAWYKKMESCLTPLPEVSNQGSIAGGEVARWPKRALTVPPRVKRGTIPGIDEKKFEDDMKLWEKRLAYYKRTTPIAQGRYRNVMDMNANLGGFAASLVKYPVWVMNAVPVNSDKDTLGAIYERGFIGTYQDWCEAFSTYPRTYDLLHADNLFSIYQDRCDITDILLEMDRILRPEGTAIIRDTVDVLTKVQAIGKRMRWDSRILDHEDGPFNPEKVLVAVKTYWTADPSEHS

SEQ ID NO: 8461 - protein, 631 aa, Triticum aestivum
MAKDYPASPKAQHLQESKKQRLTYVLVVSALCVAFYVLGAWQNSTMPNPVADSAISRVDCDTVAQRDGSVPSFAPASENVLDFDAHHQLNLSNTESAVQQFPACPLNQSEYTPCEDRKRGRLFDRDMLIYRERHCPGKDEQIRCLIPAPPKYKNPFRWPESRDVAWFDNIPHKELSIEKAVQNWIRVEGNKFRFPGGGTMFPHGADAYIDEISKLISLSDGRIRTAIDTGCGVASFGAYLLKRNIITVSFAPRDTHEAQVQFALERGVPAILGVMGSIRLPYPSRAFDLAHCSRCLIPWGGHDGLYLAEIDRILRPGGYWIHSGPPINWKTHHNGWKRAEEDLKREQDKIEDVARSLCWNKVAEKEDLSIWQKPKNHLECADIKKKHKIPHVCKSDNPDAAWYKKMESCLTPLPEVSNQGSIAGGEVARWPKRALTVPPRVKRGTIPGIDEKKFEEDMKLWEKRLAYYKRTTPIAQGRYRNVMDMNANLGGFAASLVKYPVWVMNVVPVNSDKDTLGAIYERGFIGTYQDWCEAFSTYPRTYDLLHADNLFSIYQDRCDITDILLEMDRILRPEGTAIIRDTVDVLTKVQAIAKRMRWDSRILDHEDGPFNQEKVLVAVKTYWTADPSEHS

SEQ ID NO: 8462 - protein, 631 aa, Triticum aestivum
MAKDYPASPKAQHLQESKKQRLTYVLVVSALCVAFYVLGAWQNSTMPNPVADSAISRVDCDTVAQRDGSVPSFAPASENVLDFDAHHQLNLSETESVVQQFPACPLNQSEYTPCEDRKRGRLFDRDMLIYRERHCPGKDEQIRCLIPAPPKYKNPFRWPESRDVAWFDNIPHKELSIEKAVQNWIRVEGNKFRFPGGGTMFPHGADAYIDEISKLISLSDGRIRTAIDTGCGVASFGAYLLKRNIITVSFAPRDTHEAQVQFALERGVPAILGVMGSIRLPYPSRAFDLAHCSRCLIPWGGHDGLYLAEIDRILRPGGYWIHSGPPINWKTHHNGWKRAEEDLKREQDKIEDVARSLCWNKVAEKEDLSIWQKPKNHLECADIKKKHKIPHICKSDNPDAAWYKKMESCLTPLPEVSNQGSIAGGEVARWPKRAFTVPPRVKRGTIPGIDEKKFEDDMKLWEKRLAYYKRTTPIAQGRYRNVMDMNANLGGFAASLVKYPVWVMNVVPVNSDKDTLGAIYERGFIGTYQDWCEAFSTYPRTYDLLHADNLFSIYQDRCDITDILLEMDRILRPEGTAIIRDTVDVLTKVQAIAQRMRWDSRILDHEDGPFNQEKVLVAVKTYWTADPSEHS

SEQ ID NO: 8463 - protein, 171 aa, Zea mays
MDDRTYKGGIKAYWKRRGYYRMDGDAARRRQPLPTVELGGGVAQAQAQAQPPTGDGSGRRRRRGWRVRRGQLGRRLLRALSPRRWLMRLRDAYVSAMLRLASSPAVGYGAGAPFCATATHGAAAAAAFARPAQLKEYDEKVLVEIYRSILARGGPLAGAPAAATLRLPTAV

SEQ ID NO: 8464 - protein, 492 aa, Sorghum bicolor
MAAAAALRPALSQGPEHRASLLCTPKHRVSASASRRSLRFTARASSNPGAQVSIPKQWYNLIADLPVKPPPPLHPQTHQPLNPSDLSPLFPDELIRQEVTDERFVDIPEEVIDVYKLWRPTPLIRARRLEKLLGTPAKIYYKYEGTSPAGSHKPNTAVPQAWYNAAAGVKNVVTETGAGQWGSALSFASSLFGLNCEVWQVRASFDQKPYRRLMMETWGAKVHPSPSTATEAGKRILEADPSSPGSLGIAISEAVEVAATNADTKYCLGSVLNHVLLHQTVIGEECLEQLAALGETPDVVIGCTGGGSNFGGLAFPFLREKLRGNMSPAFRAVEPAACPTLTKGVYAYDFGDTAGLTPLMKMHTLGHGFVPDPIHAGGLRYHGMAPLISHVYELGFMDAIAIQQTECFQAALQFARTEGIIPAPEPTHAIAAAIREALECKRTGEEKVILMAMCGHGHFDLAAYEKYLRGDMVDLSHPAEKLEASLAAVPKV

SEQ ID NO: 8465 - protein, 436 aa, Panicum virgatum
MVQPRRRPAGEAAAAAAPADAPASSSQRPVAPLPRRAHPAGAHRGAVRRYSRGGHRRLRALAPDAAHQGQEAGEAAGHAGEDLLQVRGDEPGGVAQGQHRRAAAWYNAAAGVRSVVTETGARQWGSALSFASSLFGLNCEVWQVRASFDQKPYRRLMMETWGATVHPSPSEATAAGRAILAADPSSPGSLGMAISEAVEVAATSADTKYCLGSVLNHVLLHQTVIGEECLEQLAALGEAPPDVVIGCTGGGSNFGGLAFPFIREKLAGRMSPEFRAVEPAACPTLTKGVYAYDFGDTAGLTPLMKMHTLGHGFVPDPIHAGGLRYHGMAPLISHVYELGFMEAIAIQQTECFQAALQFARTEGIIPAPEPTHAIAAAIREALECKKTGEEKIILMAMCGHGHFDLASYEMYLRGDMVDLSHPAEKLEASLAAVPKI

SEQ ID NO: 8466 - protein, 487 aa, Oryza sativa
MATTASVRPPLLRQAAGSEKASLLCKPKQRASVRRRSFTARASSNPVSIPKQWYNLVADLPVKPPPPLHPQTHQPLNPSDLSPLFPDELIRQEVTEERFIDIPEEVAEVYKLWRPTPLIRARRLEKLLGTPAKIYYKYEGTSPAGSHKPNTAVPQAWYNAAAGVRSVVTETGAGQWGSALSFASSLFGLTCEVWQVRASYDQKPYRRLMMETWGATVHPSPSAATESGRRILERDPASPGSLGIAISEAVEVAARDADTKYCLGSVLNHVLLHQTVIGEECLEQLAAAGDVPDVVIGCTGGGSNFGGLVFPFMREKLAGRMSPAFKAVEPAACPTLTKGVYAYDFGDTAGLTPLMKMHTLGHGFVPDPIHAGGLRYHGMAPLISHVYELGFMEAIAIQQTECFDAALKFARTEGIIPAPEPTHAIAAAIREAMECKRTGEKKVILMAMCGHGHFDLASYEKYLRGDMVDLSHSDEKLQEALAAVPKI

SEQ ID NO: 8467 - protein, 487 aa, Secale cereale
MATALRLPQLPAVPEQASSLHRLPKHRVAVTGRRSFAARAGSYPGNVGVPKQWYNLIADLPVKPPPMLHPGTHQPLNPSDLAPLFPDELIRQELTEERFIDIPDEVRDVYELWRPTPLIRAKRLEKLLGTPAKIYYKYEGTSPAGSHKGNTAVPQAWYNAAAGVKNVVTETGAGQWGSALSFASTLFGLNCEVWQVRASYDQKPYRRLMMETWGAKVHPSPSDVTEAGRKLLAADPSSPGSLGMAISEAVEVAATNADTKYCLGSVLNHVLLHQTVIGEECLEQLAAIGDTPDVVIGCTGGGSNFGGLAFPFMREKLAGRMNPQFRAVEPAACPTLTKGVYAYDYGDTAGLTPLMKMHTLGHDFVPDPIHAGGLRYHGMAPLISHVYELGFMEAMSIQQTECFEAAIQFARTEGIIPAPEPTHAIAAAIREALECKRTGEEKVILIAMCGHGHFDLAAYDRYLRGDMIDLSHSAEKLKESLGAIPKV

SEQ ID NO: 8468 - protein, 491 aa, Avena sativa
MAASAALRPPRLPAVPVPEQASSLPCLPKNRVAVAGRRSIATRAGSNPGNVSIPKQWYNLVADLPVKPPPSLHPGTHQPLVHSDLAPLFPDELIRQELTEERFIDIPQEVRDVYELWRPTPLIRAKRLEKLLGTPAKIYYKYEGTSPAGSHKANTAVPQAYYNAAAGVKNVVTETGAGQWGSALSFASTLFGLNCEVWQVRASYDQKPYRRLMMETWGAKVHPSPSDVTEAGRKLLAADPASPGSLGMAISEAVEVAATDGDTKYCLGSVLNHVLLHQTVIGEECLEQLEAVGVTPDVIIGCTGGGSNFGGLAFPFMREKLAGRMNPQFKAVEPAACPTLTKGVYAYDFGDTAGLTPLMKMHTLGHGFVPDPIHAGGLRYHGMAPLISHVYELGFMEAMSIKQTECFQAALQFARTEGIIPAPEPTHAIAAAIREALECKRTGEEKVILIAMCGHGHFDLAAYDRYLRGDMVDLAHSDEKLQESLADIPKV

SEQ ID NO: 8469 - protein, 487 aa, Triticum aestivum
MATALRPPRLPAVPEQASSLHRLPKYRVAVTGRRSFAARAGSYPGNVGVPKQWYNLIADLPVKPPPMLHPGTHQPLNPSDLAPLFPDELIRQELTEERFIDIPDEVRDVYELWRPTPLIRAKRLEKLLGTPAKIYYKYEGTSPAGSHKGNTAVPQAWYNAAAGVKNVVTETGAGQWGSALSFASTLFGLNCEVWQVRASYDQKPYRRLMMETWGAKVHPSPSDVTEAGRKLLAADPASPGSLGMAISEAVEVAATNADTKYCLGSVLNHVLLHQTVIGEECLEQLAAIGDTPDVVIGCTGGGSNFGGLAFPFMREKLAGRMSPQFKAVEPAACPTLTKGVYAYDYGDTAGLTPLMKMHTLGHDFVPDPIHAGGLRYHGMAPLISHVYELGFMEAMSIQQTECFEAALQFARTEGIIPAPEPTHAIAAAIREALECKRTGEEKVILIAMCGHGHFDLAAYDRYLRGDMIDLSHSSEKLKESLGAIPKV

SEQ ID NO: 8470 - protein, 490 aa, Brachypodium distachyon
MAAASIALHPPRLQGPGKAALPPRIPNRSRVTVSGTRSFATRAGSNPGNVSIPKQWYNLVADLPVKPPPQLHPQTHQPLKPSDLSPLFPDELIRQELTEERFVDIPEEVRDVYELWRPTPLIRAKRLEKLLGTPAKIYYKYEGTSPAGSHKANTAVPQAFYNAAAGVKSVVTETGAGQWGSALSFASTLFGLTCEVWQVRASYDQKPYRRLMMETWGAKVHPSPSEATESGRKLLAADPSSPGSLGMAISEAVEVAATNGDTKYCLGSVLNHVLLHQTVIGEECLEQLAAIGDTPDVVIGCTGGGSNFGGLAFPFMREKLAGRINPVFKAVEPAACPTLTKGVYAYDYGDTAGLTPLMKMHTLGHGFVPDPIHAGGLRYHGMAPLISHVYELGFMEAMSIQQTECFEAALQFARTEGIIPAPEPTHAIAAAIREALECKRTGEEKVILIAMCGHGHFDLAAYDRYLRGDMVDLSHSSEKLKESLAAIPKV

SEQ ID NO: 8471 - protein, 491 aa, Hordeum vulgare
MATASTALRPPRLPAVAEQASPLHRLPKNRVVAVNVRRSFAARAGSYPGNVGVPKQWYNLIADLPVKPPPMLHPGTHQPLNPSDLAPLFPDELIRQELTEERFIDIPDEVRDVYELWRPTPLIRAKRLEKLLGTPAKIYYKYEGTSPAGSHKGNTAVPQAWYNAAAGVKNVVTETGAGQWGSALSFASTLFGLNCEVWQVRASYDQKPYRRLMMETWGAKVHPSPSDVTEAGRRLLAADPSSPGSLGMAISEAVEVAATNADTKYCLGSVLNHVLLHQTVIGEECLEQLAAIGDTPDVVIGCTGGGSNFGGLAFPFMREKLAGRMNPQFKAVEPAACPTLTKGVYTYDYGDTAGLTPLMKMHTLGHDFVPDPIHAGGLRYHGMAPLISHVYELGFMEAMSIQQTECFEAAIQFARTEGIIPAPEPTHAIAAAIREALECKRTGEEKVILIAMCGHGHFDLAAYDRYLRGDMIDLSHSSEKLKESLGAIPKV

SEQ ID NO: 8472 - protein, 378 aa, Brachypodium distachyon
MAPAMASLKSSLLLPSSPLSDFSGAALSMSTQNRRRSWQPRGARMQVAAAADSKNILVMGGTRFIGVFMSRLLVKEGHQVTLFTRGKAPVTQQLPGESDAEYAEFSSKVLHLKGDRQDFDFVKTNLSAKGFDVVYDINGREATEVAPILEALPNLEQFIYCSSAGVYLKSDLLPHFETDAVDPKSRHKGKLETESLLEKSGVNWTSIRPVYIYGPLNYNPVEEWFFHRLKAGRPIPIPGAGNQITQLGHVKDLATAFIKVLGNPAASKQVYNISGTKYVTFDGLARACAKAGGFPEPEIIHYNPKDFDFGKKKAFPFRDQHFFASVEKASKELGFTPEYDLVDGLTDSYSLDFGRGTFRKEADFTTDDMILGKKLVSV

SEQ ID NO: 8473 - protein, 494 aa, Brachypodium distachyon
MEPHPHAAARALVFLSLALLAHGKPGDLNRDSFPKGFVFGTASSAYQVEGNALKYGRGPCIWDTFLKFPGATPDNATANVTVDEYHRYMDDVDNMVRVGFDAYRFSISWSRIFPSGIGRINKDGVDYYHRLINYMLANKITPYVVLYHYDLPEVLNNQYNGWLSPRVVSDFGNFADFCFKTYGDRVKNWFTINEPRMMASHGYGDGFFAPGRCTGCRFGGNSATEPYITGHHLLLSHAAAVKIYRDKYQAAQKGKIGILLDFVWYEPYNYTIEDEYAAHRAREFTLGWFLHPITYGHYPETMQKIVGDRLPSFSPEQTALVQGSADYIGINHYTSYYVKHYVNLTHMSYANDWQAKISYDRNGVLIGKQAFSNWLYVVPWGFYKAVMHVKDKFRNPVIVIGENGIDQAGNDTLPHALYDHFRIDYFDQYLHELKRAIDDGARVVGYFAWSLLDNFEWRMGFTSKFGLVYVDRKTFTRYPKDSTRWFRKMIKNEE

SEQ ID NO: 8474 - protein, 221 aa, Zea mays
METAAAAMLEAGVGRFSRAPAMAAALLAEMWAPLAVALAALATLPSLLRRLQVIVLRLRSRGKEAIQLHMGTYYSSCDDDDDDEDGDEDESSDDEVDASSSGDDGEDLKRIGFYEGAADGVFPWGGAVVRTWQGLPRRFTACASGVGAVGGASGGAFPAAVRLWGAGTASGQPWWACSADEGGCRDGAAAEVDQVVVGWRREHASQQRRRRRAVPLAHTGN

SEQ ID NO: 8475 - protein, 779 aa, Zea mays
MDCSQDPQEESHQRRENGEEAEKTADYGNALSRKEVTEELLGCVVHSEEEAYRLYCDYGHRIGFSVRKGKQSYFIGTKNIRTKDYYCSKEGLKYDEPVTEANFNRPDTRTNCKAMIRFRVDEKGRWTVIRFVPVHNHQLAKPGERHMLRSAKSLAVGKSGVIDPLASTEAHPINGFSDMTGDIVENSGYTIRECYNQVGMQSITVIEAGDSQSLVSYFKHKTNEEGMFYWDVQVDQEGRMTNFFYRDGKSRNDYGCFGDAIIFDTTYRTNKYNLICAPFVGVDHHWQNVVFGCAFLLDESVTSYAWVFKSFLESMGGRSPKSIFTDQDEAIMQAVKQVFPNTQHCFSYWHILKNAQSHLGSLNTSQAFQSMFTKCMQGSDSEEDFKESWTAMIQEYKLQDNNWLIDLYTFHHKWCSAFNKDTFDGGINSSQWGEVSSNILNGISDENTSLTRFALLLEKVVKDLRRNESEEDFRCSQTAPVRAIKHSTVLKQAAESYTHRIYKLFEAEFLDGCGATSCHETSSGGNLLRFGITMQGRGSKVWDVVLDTSTMEISCGCRKFERMGLLCSHALKVFTLQNVDTIPEKYVLKRWTKDARRSMYTLAQDDSTQQECTEAELAYRNRAMQYAYNLIIKSQELEESRKIFWDSLETGEKALEVFFEMRNMRTQAAKDADKNVKKKKKTSKGTNPKKAKQAPGVSSTGPELIVHTNEHQFQSSQDAQGNATIGRPYYYQAFPNAPIQPNQMYMHTNMHTMPLCTPQELSAYAAIRPNSMFGGAKNI

SEQ ID NO: 8476 - protein, 778 aa, Setaria italica
DSSQDSQEERHQRRENGEETEKAADYGSALSRKEATEELLGCIVHSEEEAYRLYCDYGHRIGFSVRKGKQSYFIGTKNIRTKDYYCSKEGLKYDEPVTEANFNRPDTRTNCKAMIRFRVDEKGRWTVIRFVPVHNHQLAKPGERHMLRSAKSLAFGKSGVIDPSASTESHPINGFSDTIEGDTADNSGYTIRECYNQVGMQGITVIEAGDGQSLVSYFKRRTNEEGMFYWDVQVDQEGRMTNFFYRDGKCRNDYGCFGDAIIFDTTYRTNKYNLICAPFVGVDHHWQNVVFGCAFLLDESVASYVWLFKSFLESMGGKSPKSIFTDQDEAIMQAVEQVFPNTQHCFSYWHILKNAQSHLGSLNTSQAFQHLFMQGSDSEEDFEESWTAMLREYKLQDNSWLNDLHRFRHKWCSALNKDTFDGGINSSQWGEVSNNILSGISDENTSLTRFALLLEKVVKDLRRNESEEDFRCSQTAPVRAVKHSTVLKQAAESYTHRIYKLFEAEFLDGCGATSCHETSSGGNLLRFEITMQGRGSKVWAVALDTSTMEITCGCRKFERMGLLCSHALKVFTLQNVDTIPEKYVLKRWTKDARRSMFKLAQDDSTQQECTEAELAYRNRAMQYAYNLIMKSQELEESRKIFWDSLETGEKALEVFFEMRNMRTQAAKDASNREKKKKKPSKGPNSKKAKQAPAASSAGLELIVQTNEHQYQPSQDAQGNATIGRPYYYQAFPTAPIQPNQMYMHPNVHTMPLCTSQQDHLPAYAAIRPNSNFGGAKNI

SEQ ID NO: 8477 - protein, 777 aa, Setaria italica
MDSSQDSQEERHQRRENGEETEKAADYGSALSRKEATEELLGCIVHSEEEAYRLYCDYGHRIGFSVRKGKQSYFIGTKNIRTKDYYCSKEGLKYDEPVTEANFNRPDTRTNCKAMIRFRVDEKGRWTVIRFVPVHNHQLAKPGERHMLRSAKSLAFGKSGVIDPSASTESHPINGFSDTIEGDTADNSGYTIRECYNQVGMQGITVIEAGDGQSLVSYFKRRTNEEGMFYWDVQVDQEGRMTNFFYRDGKCRNDYGCFGDAIIFDTTYRTNKYNLICAPFVGVDHHWQNVVFGCAFLLDESVASYVWLFKSFLESMGGKSPKSIFTDQDEAIMQAVEQVSLTHTLLFLLAYSEECTISFSSLNTSQAFQHLFMQGSDSEEDFEESWTAMLREYKLQDNSWLNDLHRFRHKWCSALNKDTFDGGINSSQWGEVSNNILSGISDENTSLTRFALLLEKVVKDLRRNESEEDFRCSQTAPVRAVKHSTVLKQAAESYTHRIYKLFEAEFLDGCGATSCHETSSGGNLLRFEITMQGRGSKVWAVALDTSTMEITCGCRKFERMGLLCSHALKVFTLQNVDTIPEKYVLKRWTKDARRSMFKLAQDDSTQQECTEAELAYRNRAMQYAYNLIMKSQELEESRKIFWDSLETGEKALEVFFEMRNMRTQAAKDASNREKKKKKPSKGPNSKKAKQAPAASSAGLELIVQTNEHQYQPSQDAQGNATIGRPYYYQAFPTAPIQPNQMYMHPNVHTMPLCTSQDHLPAYAAIRPNSNFGGAKNI

SEQ ID NO: 8478 - protein, 761 aa, Brachypodium distachyon
MDSSQDSPMSKNGEEAKKGEDYGNGLSRKEAAEEFIGCVVHSEEEAYRLYCDYGHRIGFSVRKGKQSYVIGTRIIRTKDYYCSKEGLKYDEPVTEANFNRPDTRTNCKAMVRFRVDDKGRWTVIRFIPVHNHQLAKPGERHMLRSAKSFAVGKSGVIDPASAESHPMNGLSDRTVDDTVEPPGYTIRDCYNHENVQGITLIGAGDCQSLVSYFKRRTNEEGMFYWDVQVDQEGRMTNFFFRDGKSKNDYDCFGDAVIFDTTYRTNKYSLICAPFVGVNHHWHNIVFGCAFLLDDSTASYVWLFKSFLESMGGRSPKSIFTDQDEAIMQAAEQVFPNTQHCFSYWHILKNAQSHLGTVNTSQDFQNMFMKCMQGSDTKMELEESWAAMLHEYKLQDNDWLNDLYRFHNRWCSAFNKDTFDGGINSSQWGEVSNNILTGIADESTSLTRFALLLEKAVKSLRRNESEEDFRCSQTAPVRAIKHSTVLKQAAESYTHRIYKLFEAEFLDGCGATSCHENSCGGNLLRFEITMQGRGSKVWTVLLDTSTMEISCGCRKFERMGLLCSHALKAFSLQNVDTIPEKYILKRWTKDARRSMYKLSQEDSTQQECTEAELAYRNRAMQYAYSLIMKSQELEESRKIFWDSLETGEKALEVFFEIRSLHAQPAKDASKTGKKKSSKGPSNKKARQALPSSSPVPGILAQANEHQFQAAQDAHGNSTIGRPFYFQAFSSTPCQPNQIYIHPNTMPVCAPQDLSAYPAIRPS

SEQ ID NO: 8479 - protein, 156 aa, Oryza sativa
MMMTEVANHSKRNHNESYFTGKAAVTSSSEEFGSMTSKKPRNTSPRDAPVSPKEKKDKIGERVAALQQLVSPFGKTDTASVLQEASGYIKFLHQQLEVLSSPYMRAPPVPGAAPEDPDHYSLRNRGLCLVPVDQTLQLTQSNGADLWAPANTTRRR

SEQ ID NO: 8480 - protein, 160 aa, Leymus cinereus x Leymus triticoides
MMMTQVANHSKRNHTDSYFSGKQQAVATSSGSEEFGGMGSKKPRNASPRGAGPISPKEKKDKVGERVAALQQLVSPFGKTDTASVLQEASGYIKFLHQQLEVLSSPYMRPPPAPGAEPEDPDHYSLRNRGLCLVPVEQTLQLTQSNGADLWAPANTTRRC

SEQ ID NO: 8481 - protein, 162 aa, Brachypodium distachyon
MMMTEVANHSKRDHTDSYFSGKAGMATSGSGSGSEEFGSMGSKKPRNSSPRSGAPISPKEKKDKVGERVAALQQLVSPYGKTDTASVLQEASGYIKFLHKQLETLSSPYMRAPPAPGAAPEDPEHYSLRNRGLCLVPVDQTLQLTQDNGADLWAPANTARRR

SEQ ID NO: 8482 - protein, 163 aa, Avena sativa
MMMTEVANHSKRNHTDSYFSGKQAVATSSGSEEFVVGMGSKKPRNASPRGGGGGGPISPKEKKDKVGERVAALQQLVSPYGKTDTASVLQEASGYIKFLHQQLEVLSTPYMRAPPAPGAEPEDPDHYSLRNRGLCLVPVEQTLQLTQSNGADLWAPAHTTKRR

SEQ ID NO: 8483 - protein, 453 aa, Zea mays
MVRWGEMVEEEEDDEYAKLVRRMNPPRVVIDNDSCGNATVIRVDRVNKHGILLEAVQVLVDLNLVITKAYISSDGNWFMHVFNVTDQDGSKLHNREVIDHIQKCLESDGYLVPPANGYALPEDQFTSIELTGADRPGLLSEVCAVLATLSCNIVKAEVWTHDGRTAAVIQVTDEATGRAVHDAGRLSRVQELLRDVMRGDGTCNRGGTGISAERRLHTLMLDSVGGGGAEEAGGGRDESGGCGVARPKVVVMDCAERRYTVVILRCRDRPKLLFDTLCALADLQYVVFHGTVDAEGASKDKEAYQEYYIRHVDGHPVRSDAERARLVRCLEAAVERRASNGLELEVWTEDRVGLLSEITRVFRENSLSIIRAAITTRDGKAEDTFYVSDAYGNPVDGRTMDAVGEQLGHAVLRVKRGGHDAPVKHEAEGGAVSVLGSLLKSSFQGLRLIRSYS

SEQ ID NO: 8484 - protein, 463 aa, Setaria italica
MVRCVEMVAEEEDDDEYAKLVRRMNPPRVVIDNDSCNNATVIRVDRVKKHGILLEAVQVLVDLNLVITKAYISSDGNWFMDVFNVTDQDGSKLQNREVIEHIQKCLESEDYLALPAIGLKDGAAPSEDQSTSIELTGTDRPGLLSEVCAVLASLSCNIVKAEVWTHERRAAAVIQITDEATGLAIRDAGRLSKVQELLRNVMQGDGTARRGGGSTCTGGVSVGAARAERRLHKLMLDDGAGGSAGEEAVDGEDRCGKARPKVAVMDCTERQYTVVILQCRDRPKLLFDTLCALTDLQYVVFHGTVDAERGSKEAYQEYYIRHVDGYPVRSDAERTRLVRCLEAAVERRASDGLELEVRTEDRVGLLSEITRVFRENSLSIIRAAIATRDGRAEDTFYVSDAYGNPVDGRTVDAVGEQLGHAVLRVKRGGGGRGPPVAEGGAVSVLGSLLKGSFQGLRLIRSYS

SEQ ID NO: 8485 - protein, 383 aa, Zea mays
MGVGKLMNDVKPYLAMVLLQVGFSGMYIVSVASLKRGMNHFVLVVYRNLVATVVMAPFALLFERRVRPKMTPLIFLKIMGLAVLEPVLDQNMYYLGAKLTSATFASALVNILPAITFLLALALRMERLRLRSLRSQAKVVGTVCTVAGAVLMILYHGPVVPFPWSAGRLHHHVPAAAVESQSSASWLNGICMIIGSCLCWSGFFILQSNTLQSYPAELTLTTLICFLGSVLTGGVALVAERRDMSAWVIGFDTRLFTAVYSGIVCSGVAFYVQGIVTQARGPVFVTAFQPLCMIITTVLGSTILKEETTLGSVIGAAIIVVGLYCLIWGKSKDHLGSNGGKPGAAAVAELPLTSSAPAWSNGKQALAVVETTPPSSLPNKCVH

SEQ ID NO: 8486 - protein, 352 aa, Secale cereale
MGDDHGAKLVKSLRGAAQKYVGVGFFLGFFLVLLTYFTVSEQFAIAAPNAIRRTSPGHQTPTAPAVADKTVQQQQLPVKKEEAPLPEQEQVPPVDEEPHRETEEPNSETEEDPKPTDEASKIVTTAAEESAPAKKPACDIQGPWASDVCDLAGGSGGVRIHGSTHTVLVPPTIESGGSNPNPQEWRVLPYSRKHMSGIKEITVRELPTAADAPRCAVTSQVPALVFAMGGLTGNYWHDFSDVMIPLYLQASRFDGEVQLVVTNIQPWYAGKYRHIIARLSRYDVVDMDKDDQVRCFPSAVVGIRMHKEFSIDPAKEPTGHSMPEFTKFLRSASRSRAPRPCGSPPGATRSRG

SEQ ID NO: 8487 - protein, 339 aa, Secale cereale
MSGIKEITVRELPSAADAPRCAVTSQVPALVFAMGGLTGNYWHDFSDVMIPLYLQASRFDGEVQLVVTNIQPWYAGKYRHIIARLSRYDVVDMDKDDQVRCFPSAVVGIRMHKEFSIDPAKDPTGHSMPEFTKFLRSVFALPRAAPMRVTAGSDKKPRMMIISRRHPRKLVNVAEVVALAKRIGFEVVIGDPPFNVDVGDFAREVNAADVLMGVHGAGLTNSLFLPTGGRLHPGEPPSATWSTSGRWTSGAPAVDDGPQVHGLLVRHGGEHAGGHARARPPGGQGPGVDPPQRLEQGGRVLPRQARRQARPPALRARAPQGHGHAQRVATRSLRSSFIG

SEQ ID NO: 8488 - protein, 525 aa, Leymus cinereus x Leymus triticoides
  misc_feature (96)..(96): Xaa can be any naturally occurring amino acid
  misc_feature (102)..(102): Xaa can be any naturally occurring amino acid
  misc_feature (109)..(109): Xaa can be any naturally occurring amino acid
  misc_feature (271)..(271): Xaa can be any naturally occurring amino acid
  misc_feature (449)..(449): Xaa can be any naturally occurring amino acid
MGDDHGAKLVKSLRGAAQKYVGVGFFLGFFLVLLTYFTVSEQFAIAAPNAIQRSSPAHPTPTAPAVAEKTAQQQQQLPVKKEEAPLPEQVQEKPPXVDEEPXTETEEDXTPHTETEEGQKPIDDASKIVTTAEESAPAKKPACDIQGPWASDVCDLAGGSGGVRIHGSTHTVLVPPTIESGGSNPNPQEWRVLPYSRKHMSGIKEITVRELATAADAPRCAVTSQVPALVFAMGGLTGNYWHDFSDVMIPLYLQASRFDGEVQLVVTNIQXWYAGKYRHIIARLSRYDVVDMDKDDQVRCFPSAVVGIRMHKEFSIDPTKEPTGHSMPEFTKFLRNVFALPRAAPMRVTAGSDKKPRMMIISRRHPRKLVNVAEVVALAKRIGFEVVIGDPPFNVDVGDFAREVNAADVLMGVHGAGLTNSLFLPTGAVFIQVNPFGKMEHIGEVDFGXPAVDMGLKYMAYSCGMEESTLVDTLGRDHPAVKDPESVHRSGWNKVAEYYLGKQDVKLDLQRFEPVLLKAMAMLRE

SEQ ID NO: 8489 - protein, 540 aa, Hordeum vulgare
MGDDHGAKLVKSLRGAAQKYVGVGFFLGFFLVLLTYFTVSEQFAIAAPNAIRRTSPGHPTPTSPAVAEKTVQQQQLPVKKEEAPLPEHEQVHEKPPPVDDDEEPHRETEEPNSQTEHPIDEASKIVTTAEESAPAKKPACDIQGPWASDVCDLAGGSGGVRIHGSAHTVLVPPTIESGGSNPNPQEWRVLPYSRKHMSGIKEITVRELATPADAPRCAVTSQVPALVFAMGGLTGNYWHDFSDVMIPLYLQASRFDGEVQLVVTNYQRWYAGKYRHIIARLSRYDVVDMDKDDQVRCFPSAVVGIRMHKEFSIDPAKEPTGHSMPEFTKFLRNVFALPRAAPMGVTAGPSDGKKKPEDDDHLPAPPEEAGERGRGGGPRQADRVRGGDRGPAVQRGRRRLRAGGERRRRAHGGARRRPDQLALPAHGGGVHPGEPLRQDGAHRGGGLRDAGGGHGAQVHVLLVRHGGEHAGGHPGARPPGGQGPGVDPPERVEQGGGVLPRQAGRQARPPEVRARAPQGHGDAQRVATLPPSDRPCSRLA

SEQ ID NO: 8490 - protein, 254 aa, Secale cereale
MVRRQVPPHHRAAVEVRRRGHGQGRPGALLPLRRRRHPHAQGVQHRPGQGAHGPLHARVHQVPPQRLRAPARRAHAGHRREQQEAEDDDHLPAPPEEARQRGGGGGAGQADRVRGGHRGPAVQRGRGRLRARGERRRRAHGGARRRPHQLALPAHGGRLHPGEPLGNMEHIGEVDFGAPAVDMGLKYMAYSCGMEESTLVDTLGRDHPAVKDPESIHRSGWGKVAEYYLGKQDVKLDLQRFEPVLRKAMAMLRE

SEQ ID NO: 8491 - protein, 462 aa, Secale cereale
QTPTAPAVADKTVQQQQLPVKKEEAPLPEQEQVPPVDEEPHRETEEPNSETEEDPKPTDEASKIVTTAAEESAPAKKPACDIQGPWASDVCDLAGGSGGVRIHGSTHTVLVPPTIESGGSNPNPQEWRVLPYSRKHMSGIKEITVRELPSAADAPRCAVTSQVPALVFAMGGLTGNYWHDFSDVMIPLYLQASRFDGEVQLVVTNIQPWYAGKYRHIIARLSRYDVVDMDKDDQVRCFPSAVVGIRMHKEFSIDPAKDPTGHSMPEFTKFLRSVFALPRAAPMRVTAGSNKKPRMMIISRRHPRKLVNVAEVVALAKRIGFEVVIGDPPFNVDVGDFAREVNAADVLMGVHGAGLTNSLFLPTGAVFIQVNPFGNMEHIGEVDFGAPAVDMGLKYMAYSCGMEESTLVDTLGRDHPAVKDPESIHRSGWSKVAEYYLGKQDVKLDLQRFEPVLRKAMAMLRE

SEQ ID NO: 8492 - protein, 440 aa, Secale cereale
EEAPLPEHEQVPPVDEEPHRETEEPNSETEEDPKPTDEASKIVTTAAEESAPAKKPACDIQGPWASDVCDLAGGSGGVRIHGSTHTVLVPPTIESGGSNPNPQEWRVLPYSRKHMSGIKEITVRELPTAADAPRCAVTSQVPALVFAMGGLTGNYWHDFSDVMIPLYLQASRFDGEVQLVVTNIQPWYAGKYRHIIARLSRYDVVDMDKDDQVRCFPSAVVGIRMHKEFSIDPAKEPTGHSMPEFTKFLRSVFALPRAAPMRVTAGSDKKPRMMIISRRHPRKLVNVAEVVALAKRIGFEVVIGDPPFNVDVGDFAREVNAADVLMGVHGAGLTNSLFLPTGAVFIQVNPYGKMEHIGEVDFGAPAVDMGLKYMAYSCGMEESTLVDTLGRDHPAVKDPESIHRSGWGKVAEYYLGKQDVKLDLQRFEPVLRKAMAMLRE

SEQ ID NO: 8493 - protein, 519 aa, Secale cereale
GRPWRQAGEEPAGRGAQYAGVGFFLGFSSSSSPTSPSPSSSPSPRPTLSGGPRRGTRRRPPPPWQTRRCSSSSSPSKRRKHLCQSMSKYHLWTRSPHRETEEPNSETEEDPKPTDEASKIVTTAEESAPAKKPACDIQGPWASDVCDLAGGSGGVRIHGSTHTVLVPPTIESGGSNPNPQEWRVLPYSRKHMSGIKEITVRELPSAADAPRCAVTSQVPALVFAMGGLTGNYWHDFSDVMIPLYLQASRFDGEVQLVVTNIQPWYAGKYRHIIARLSRYDVVDMDKDDQVRCFPSAVVGIRMHKEFSIDPAKEPTGHSMPEFTKFLRSVFALPRAAPMRVTAGPVSDKKPRMMIISRRHPRKLVNVAEVVALAKRIGFEVVIGDPPFNVDVGDFAREVNAADVLMGVHGAGLTNSLFLPTGAVFIQVNPFGKMEHIGEVDFGAPAVDMGLKYMAYSCGMEESTLVDTLGRDHPAVKDPESIHRSGWGKVAEYYLGKQDVKLDLQRFEPVLRKAMAMLRE

SEQ ID NO: 8494 - protein, 460 aa, Secale cereale
SPTSPSPSSSPSPRPTLSGGPPGHQTPTAPAVADKTVQQQQLPVKKEEAPLPEQEQVPPVDEEPHRETEEPNSETEEDPKPTDEASKIVTTAAEESAPAKKPACDIQGPWASDVCDLAGGSGGVRIHGSTHTVLVPPTIESGGSNPNPQEWRVLPYSRKHMSGIKEITVRELPTAADAPRCAVTSQVPALVFAMGGLTGNYWHDFSDVMIPLYLQASRFDGEVQLVVTNIQPWYAGKYRHIIARLSRYDVVDMDKDDQVRCFPSAVVGIRMHKEFSIDPAKDPTGHSMPEFTKFLRSVFALPRAAPMRVTAGSNKKPRMMIISRRHPRKLVNVAEVVALAKRIGFEVVIGDPPFNVDVGDFAREVNAADVLMGVHGAGLTNSLFLPTGAVFIQVNPYGKMEHIGEVDFGAPAVDMGLKYMAYSCGMEESTLVDTLGRDHPAVKDPESIHRSGWSKVAEYY

SEQ ID NO: 8495 - protein, 528 aa, Sorghum bicolor
MEMEAVVVAAAALCGALALYLYHALWVAPERVRAALRAQGVAGPRPSFPYGNRADMRRAAAAAAAVAPAAGTTQRGGIVHDYRQALFPHYERWRKEYGPIFTYSIGSMVFLHASRADVVRDLGRCGTSLDLGKSSYMKVTHRPLFGDGILKSSGEAWAHQRSLIAPEFCPNKVKGMVDLMVGSATALVASWEDRISSGGGGGGAELELKIDDDIRAYSADVISRTCFGSSYVKGKRIFAAIRELQKAVSKPNLLAEMTGLSFLPTRTNTEAWRLNRVVRDLVLDVVRESGGDDRNLLNAMLRSAAAESGGGGRVAAVEEFVVDNCKNIYFAGYETTAVTAAWCTMLLALHPEWQDRVRDEARQACAAGAAPDFASLHKMKKLTMVIQETLRLYPAGSVVSRQALRDVTLGGVRVPAGVNIYVPVSTVHLDPELWGADAGEFDPGRFADDAHHQRQPHAYLPFGAGARICLGQAFAMAELKVLLALVLSRFHISLSPAYVHSPALRLIVEPEHGVRLVLRNVEPSPGAS

SEQ ID NO: 8496 - protein, 246 aa, Saccharum officinarum
MPKIKNLSNACKVSFSPQGPISEEALERVRALLDEIRPLDVGLDNEAQIARNWSSSTRPSNGRRGRNGANQFSATIKYLHIHECESFSMGIFCMPPSSVIPLHDHPGMTVLSKLLYGRLHAESYDWVDVPDHPIDQLQTRPAKLVKDCEMTAPETTILYPNAGGNIHTFRAITPCALFDVLSPPYSAEDGRHCSYFRKSQMNQPPVVLPAEIDSSQVIWLEELEDHQPPEGFVVARGLYKGPVIRR

SEQ ID NO: 8497 - protein, 246 aa, Zea mays
MPKIKNLSNACKVSFSPEGPISEEVLERVRALLDEIRPLDVGLDNEAQIARNWSSTTRPSNGRRGRNGANQFTAPIKYLHIHECESFSMGIFCMPPSSVIPLHNHPGMTVLSKLLYGRLHAESYDWVDVPDHPIDQLQPRPAKLVKDCEMTAPETTILYPNAGGNIHTFRAITPCALFDVLSPPYSAEDGRHCSYFRKSQMNQPSVVLPAEIDSTQVVWLEELEDHQPPEGFVVARGMYKGPVIRR

SEQ ID NO: 8498 - protein, 246 aa, Zea mays
MPKIKSLSNACRVSFSPEGPISEEALERVRALLDMIRPLDVGLDNEAQIARNWSSSTRPSNGRRGRNGANQFAAPIKYLHIHECESFSMGIFCMPPSSVIPLHNHPGMTVLSKLLYGRLHAESYDWVDIPDHPIDQLQTRPAKLVKDCEMTAPETTILYPNAGGNIHTFRAITPCALFDVLSPPYSAEDGRHCSYFRKSQMNQPPVVLPAEIDSSQVVWLEELEDHQPPEGFVVARGLYKGPVIRR

SEQ ID NO: 8499 - protein, 69 aa, Unknown
  Sequence found in Organisms: Zea mays, Sorghum bicolor
MGFWVTTLIFLLAGVAASLFTLLCCNRGPSTNLFHLTLVTTAVICCWMMYAIVYLAQMKPLINPILSGE

SEQ ID NO: 8500 - protein, 69 aa, Setaria italica
MGFWVTTLIFLIAGVAASLFTLLCCNRGPSTNLFHLTLVTTAVICCWMMYAIVYLAQMKPLINPILSGE

SEQ ID NO: 8501 - protein, 69 aa, Setaria italica
MGFWVTTLIFLIAGVAASLFTLLCCNRGPSTNLFHLTLVTTAIICCWMMYAIVYLAQMKPLINPILSGE

SEQ ID NO: 8502 - protein, 173 aa, Pennisetum glaucum
MSKRLVSRLLGMFQSRTQVGVDKAGNRYFTRVEEVDGAMKERRWVEFKGADQDSTTVPVEWICWLNGQRKKAPTPEELAELEARRERVKQNIELLKKKEEEERKAGVRHIKKIGKSESPNLQSFVKQQFHGPEEVSRPKDATDAEDSITDNERTSEPTGTGATFKPGTWQPPT

SEQ ID NO: 8503 - protein, 69 aa, Saccharum officinarum
TCRVSLPDRAIQREGARSSSRRRSSPRPPPPNTTMGFWVTTLIFLLAGVAASLFTLLCCNRGPPQTYSI

SEQ ID NO: 8504 - protein, 69 aa, Panicum virgatum
MGFWVSTVIFLLAGVVASLFTLLCCNRGPSTNLFHLTLVTTAVICCWMMYAIVYLAQMKPLINPILSGE

SEQ ID NO: 8505 - protein, 69 aa, Panicum virgatum
MGFWVSTVIFLLAGVVASLFTLLCCNRGSSTNLFHLTLVTTAVICCWMMYAIVYLAQMKPLINPILSGE

SEQ ID NO: 8506 - protein, 69 aa, Oryza sativa
MGFWVTTLIFLLAGFVASLFSLLCCNRGPSTNLFHLTLVITATVCCWMMWAIVYLAQLKPLINPILSGE

SEQ ID NO: 8507 - protein, 69 aa, Avena sativa
MGFLVTSAIFLLAGIVGCLFSLLCCNRGPSTNLFHLTLVTTATVCCWMMWAIVYLAQMKPLINPILSGE

SEQ ID NO: 8508 - protein, 69 aa, Lolium multiflorum
MGFLVTSGIFLLAGIIGCLFSLLCCNRGPSTNLFHLTLVITATVCCWMMWAIVYLAQMKPLINPILSGE

SEQ ID NO: 8509 - protein, 103 aa, Festuca arundinacea
GTRRSLLHPDPATRPAIRRSRSSRGEHPPSSQPAMGFLVTSGIFLLAGIIGCLFSLLCCNRGPSTNLFHLTLVITATVCCWMMWAIVYLAQMKPLINPILSGE

SEQ ID NO: 8510 - protein, 70 aa, Allium cepa
MGFWSTTLIFILAGVVACLSALLCCNRGPSTNLFHLTLLITATVCCWMMWAIVYLAQMNPLIVPILSEGE

SEQ ID NO: 8511 - DNA, 689 bp, Sorghum bicolor
aaagaatggcttcctctatgctctcttccgctactatggttgcctctccggctcaggccactatggtcgctcctttcaacggacttaagtcctccgctgccttcccagccacccgcaaggctaacaacgacattacttccatcacaagcaacggcggaagagttaactgcacaaaagatgagactctactagtcttcactcttgtggtttcctcggtttctattttcttattcgggatcttgcttttcagggttctcatctctgcaactcgcgattttcgcgagagaaccaaatccaagttggtgaagatcatgatttgggctggcatagtagttattacctttgcaattgcggttcgaatctatccgatctttatctttttgctcaaagaacgaataaaaccccttgttgaagccctttatgataagcttccctggatctgggaagtttctctttcacggtattgggatcgtttgatcgatttccttgatcgctacttatgggcgtgcgctcaaaggatacaaacagggattcgcaaacaaaaaggggaattcgtagtcactttttcctgtcgcgtaaaaaaaaggctttacgcgagagcaatagaggttgggatacatctatctcttctgagcaacctcttttggattcttaagaccacccttgcagtaggataccgtctgctttag

SEQ ID NO: 8512 - protein, 227 aa, Sorghum bicolor
MASSMLSSATMVASPAQATMVAPFNGLKSSAAFPATRKANNDITSITSNGGRVNCTKDETLLVFTLVVSSVSIFLFGILLFRVLISATRDFRERTKSKLVKIMIWAGIVVITFAIAVRIYPIFIFLLKERIKPLVEALYDKLPWIWEVSLSRYWDRLIDFLDRYLWACAQRIQTGIRKQKGEFVVTFSCRVKKRLYARAIEVGIHLSLLSNLFWILKTTLAVGYRLL

SEQ ID NO: 8513 - DNA, 527 bp, Sorghum bicolor; identical to SEQ ID NO: 185

SEQ ID NO: 8514 - protein, 173 aa, Sorghum bicolor; identical to SEQ ID NO: 664

SEQ ID NO: 8515 - DNA, 3395 bp, Zea mays; identical to SEQ ID NO: 250

SEQ ID NO: 8516 - protein, 1129 aa, Zea mays
MASSMLSSATMVASPAQATMVAPFNGLKSSAAFPATRKANNDITSITSNGGRVNCLRNGNEGMSTIPGFSQIQFEGFCRFINQGLAEELEKFPTIKDPDHEIAFQLFAKGYQLLEPSIKERNAVYESLTYSSELYVSARLIFGFDVQKETISIGNIPIMNSLGTFIINGIYRIVINQILLSPGIYYRSELDHKGISIYTGTIISDWGGRSELAIDKKERIWARVSRKQKISILVLSSAMGSNLREILDNVSYPEIFLSFPNAKEKKRIESKEKAILEFYQQFACVGGDLVFSESLCEELQKKFFQQKCELGRVGRRNMNRRLNLDIPQNNTFLLPRDVLAATDHLIGMKFGTGILDDDDMNHLKNKRIRSVADLLQDQFGLALGRLQHAVQKTIRRVFIRQSKPTPQTLVTPTSTSILLITTYETFFGTYPLAQVFDQTNPLTQTVHGRKVSCLGPGGLTGRTASFRSRDIHPSHYGRICPIDTSEGINVGLTGSLAIHARIDHWWGSIESPFYEISEKAKEKKERQVVYLSPNRDEYYMIAAGNSLSLNQGIQEEQVVPARYRQEFLTIAWEQIHVRSIFPFQYFSIGGSLIPFIEHNDANRALMSSNMQRQAVPLSRSEKCIVGTGLERQTALDSRVSVIAQREGKIISSDSHKILLSSSGKTISIPLVAHRRSNKNTCMHQKPRVPRGKSIKKGQILAEGAATVGGELALGKNVLVAYMPWEGYNFEDAVLISERLVYEDIYTSFHIRKYEIQTDTTSQGSAEKITKQIPHLEEHLLRNLDRNGVVRLGSWVETGDILVGKLTPQIASESSYIAEAGLLRAIFGLEVSTSKETSLKLPIGGRGRVIDVKWIQRDPFDIMVRVYILQKREIKVGDKVAGRHGNKGIISKILPRQDMPYLQDGTPVDMVFNPLGVPSRMNVGQIFESSLGLAGDLLKKHYRIAPFDERYEQEASRKLVFSELYEASKQTKNPWVFEPEYPGKSRIFDGRTGDPFEQPVLIGKSYILKLIHQVDEKIHGRSTGPYSLVTQQPVRGRAKQGGQRIGEMEVWALEGFGVAHILQEILTYKSDHLIARQEILNATIWGKRVPNHEDPPESFRVLVRELRSLALELNHFLVSEKNFQVNREDV

SEQ ID NO: 8517 - DNA, 3233 bp, Zea mays; identical to SEQ ID NO: 137

SEQ ID NO: 8518 - protein, 1075 aa, Zea mays; identical to SEQ ID NO: 616

SEQ ID NO: 8519 - DNA, 827 bp, Zea mays; identical to SEQ ID NO: 208

SEQ ID NO: 8520 - protein, 273 aa, Zea mays; identical to SEQ ID NO: 687

SEQ ID NO: 8521 - DNA, 827 bp, Zea mays; identical to SEQ ID NO: 208

SEQ ID NO: 8522 - protein, 273 aa, Zea mays
MAKHLYKTPIPSTRKGTVDRQVKSNPRNKLIHGRHRCGKGRNARGIITARHRGGGHKRLYRKIDFRRNQKDISGRIITIEYDPNRNAYICLIHYGDGEKRYILHPRGAIIGDTIVSGTKVPISMGNALPLTDMPLGTAIHNIEITRGRGGQLARAAGAVAKLIAKEGKLATLRLPSGEVRLVSQNCLATVGQVGNVGVNQKSLGRAGSKCWLGKRPVVRGVVMNPVDHPHGGGEGKAPIGRKKPTTPWGYPALGRRTRKRKKYSDSFILRRRK

SEQ ID NO: 8523 - DNA, 827 bp, Zea mays; identical to SEQ ID NO: 208

SEQ ID NO: 8524 - protein, 150 aa, Zea mays; identical to SEQ ID NO: 7881

SEQ ID NO: 8525 - DNA, 666 bp, Artificial Sequence
  35S_pqfnc Promoter
gcatgcctgcaggtcaattctcatgtttgacagcttatcatcggtgcgatgccccccatcgtaggtgaaggtggaaattaatgatccatcttgagaccacaggcccacaacagctaccagtttcctcaagggtccaccaaaaacgtaagcgcttacgtacatggtcgataagaaaaggcaatttgtagatgttaacatccaacgtcgctttcagggatcccccctcagaagaccagagggctattgagacttttcaacaaagggtaatatcgggaaacctcctcggattccattgcccagctatctgtcacttcatcgaaaggacagtagaaaaggaaggtggctcctacaaatgccatcattgcgataaaggaaaggctatcgttcaagatgcctctaccgacagtggtcccaaagatggacccccacccacgaggaacatcgtggaaaaagaagacgttccaaccacgtcttcaaagcaagtggattgatgtgatatctccactgacgtaagggatgacgcacaatcccactatccttcgcaagacccttcctctatataaggaagttcatttcatttggagaggacaggcttcttgagatccttcaacaattaccaacaacaacaaacaacaaacaacattacaattactatttacaattaca

SEQ ID NO: 8526 - DNA, 781 bp, Artificial Sequence
  35S_pJJ Promoter
tcgacctgcagccaagcttggcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgctagagcagcttgagcttggatcagattgtcgtttcccgccttcagtttagcttcatggagtcaaagattcaaatagaggacctaacagaactcgccgtaaagactggcgaacagttcatacagagtctcttacgactcaatgacaagaagaaaatcttcgtcaacatggtggagcacgacacacttgtctactccaaaaatatcaaagatacagtctcagaagaccaaagggcaattgagacttttcaacaaagggtaatatccggaaacctcctcggattccattgcccagctatctgtcactttattgtgaagatagtggaaaaggaaggtggctcctacaaatgccatcattgcgataaaggaaaggccatcgttgaagatgcctctgccgacagtggtcccaaagatggacccccacccacgaggagcatcgtggaaaaagaagacgttccaaccacgtcttcaaagcaagtggattgatgtgatatctccactgacgtaagggatgacgcacaatcccactatccttcgcaagacccttcctctatataaggaagttcatttcatttggagagaacacgggggactcttgaccatgg

SEQ ID NO: 8527 - DNA, 877 bp, Artificial Sequence
  35S (OLD) Promoter
aagcttgcatgcctgcaggtccccagattagccttttcaatttcagaaagaatgctaacccacagatggttagagaggcttacgcagcaggtctcatcaagacgatctacccgagcaataatctccaggaaatcaaataccttcccaagaaggttaaagatgcagtcaaaagattcaggactaactgcatcaagaacacagagaaagatatatttctcaagatcagaagtactattccagtatggacgattcaaggcttgcttcacaaaccaaggcaagtaatagagattggagtctctaaaaaggtagttcccactgaatcaaaggccatggagtcaaagattcaaatagaggacctaacagaactcgccgtaaagactggcgaacagttcatacagagtctcttacgactcaatgacaagaagaaaatcttcgtcaacatggtggagcacgacacacttgtctactccaaaaatatcaaagatacagtctcagaagaccaaagggcaattgagacttttcaacaaagggtaatatccggaaacctcctcggattccattgcccagctatctgtcactttattgtgaagatagtggaaaaggaaggtggctcctacaaatgccatcattgcgataaaggaaaggccatcgttgaagatgcctctgccgacagtggtcccaaagatggacccccacccacgaggagcatcgtggaaaaagaagacgttccaaccacgtcttcaaagcaagtggattgatgtgatatctccactgacgtaagggatgacgcacaatcccactatccttcgcaagacccttcctctatataaggaagttcatttcatttggagagaacacgggggactctagaggatcc

SEQ ID NO: 8528 - DNA, 2322 bp, Artificial Sequence
  AT 6669 (OLD) Promoter
aagctttaagctccaagcccacatctatgcacttcaacatatctttttctagatgagttggtaaaagtagaaaaagatatgatgattttaaatttgtttctatttatatgtgttcatcgaaacttcattttttttagttttaatagagagtttatatgacttttaaaaattgatttaaaactgtgtcaaaaattaaaaggacaataaaaaatttgcatacaaccgaaaatacttatatttagacaagaaaaaataatacttgtgatgctgattttattttattatatatcatgaatcatgatcatccaattttccggataagccaaagtcaaaatgatgggttccccctaatcttttatgctgagaaatagatgtatattcttagatagtaatataaaattgggttaaagaatgatgattcgattatagcctcaactagaagatacgtgtagtgcaggtgtgtagttaactggtggtagtggcagacaaccagattaggagttaaataaagcctttagatttgagagattgaaatattcgattggaacctttctagatttttacagccatctaaaattagatgcagatcacctactaccattcaaaaatgaacaaaataatttcatttacattttcctagcataagatataataataaaatagtgctcattttaattactttttctaaatattttcgttattttaaattttgcttgtctatactctacagctcatttaataacggaaacaaaaataattgcagggatacggatgggtagctttcaaaacttacatcatcttctgtttcttgagatcaactatttttggagctttgtctcaatcgtaccaaaggataatggtcctacctccttttgcattcttaactttatcttctctacttatttcttttttgggatttttgggggtattattttatcttttgtagatatacacattgatttactacaaacgtatactactatccatcttcaactcttcggaatatgatttcgaaaaaactatgaagattaacgggtatcttaaacatgttaagatacaccggacaattttcatttagaagaattgatatgcaattaacaataaatagttgatgatcttttagttttgaagatgtgcgttaagacttaagcgtgtggtaacaaggtgggactcgggcaacgcaaagccttgtagagtccacttgctcaacttgtctttcttttatctcttttccaagtctcaagattcaatgaactccgtgtaacacaaacacgcccatagatgagctcatttttggtatttccaatattgccactccatgataatatcatctagggatggggttcatttattttgaaatctcaacaaatctcgtcgattctaacacacatgattgatttgtttacttacttgaaagttggcaactatctgggattaaaatttatctttttctactgctagctagaagcatctatatatgttagcctaatacgtggaagatgtcattgctaataatggctaaagatgtgtattaatttttcttcttttttccttgaatttttgttctttgacataaactatgctgtcaaaatgtgtagaatctttttacataaatcattccctgttacacactaaaaggttcacaacggacgattgtattggacttccagatcataaaccatgcaaaactgaaaaccacaagaataattagttctaactttagaacgttcgtacgtgtttcatgttcaaaaagcgtcaattataaaagttgggaaattacttttgagttttgacatttctaaggacagtcaaatatgacaacattgggatgcaacttaccttgtattaacttattttgttataaaaccatatattacatattttaaagggttgataaataatcaaatataccaaaacatagcttttcaatatatttgtaaaacacgtttggtctactagctaattatgagaacatttgttcaatgcatgattatctagtatctactagtggattatgaaaattagatattttcattgcatgattatcttccatatatagtgataacatcaaaagaatctacaccaattattgcattttttcattatataataagcactaaactgtaaaattatattcagccacccaaaccatgacaaatcaccttaaaggcttaaacacataacagccattacgagtcacaggtaagggtataatagtaaagaatcaatctatataatatacgacccaccctttctcattctttctggagagtaacatcgagacaaagaagaaaaactaaaaaagagaaccccaaaggatcc

SEQ ID NO: 8529 - DNA, 2318 bp, Artificial Sequence
  AT 6669 (NEW) Promoter
aagctttaagctccaagcccacatctatgcacttcaacatatctttttctagatgagttggtaaaagtagaaaaagatatgatgattttaaatttgtttctatttatatgtgttcatcgaaacttcattttttttagttttaatagagagtttatatgacttttaaaaattgatttaaaactgtgtcaaaaattaaaaggacaataaaaaatttgcatacaaccgaaaatacttatatttagacaagaaaaaataatacttgtgatgctaattttattttattatatatcatgaatcatgatcatccaattttccggataagccaaagtcaaaatgatgggttccccctaatcttttatgctgagaaatagatgtatattcttagatagtaatataaaattgggttaaagaatgatgattcgattatagcctcaactagaagatacgtgtagtgcaggtgtgtagttaactggtggtagtggcggacaaccagattaggagttaaataaagcctttagatttgagagattgaaatattcgattggaacctttctagatttttacagccatctaaaattagatgcagatcacctactaccattcaaaaatgaacaaaataatttcatttacattttcctagcataagatataataataaaatagtgctcattttaattactttttctaaatattttcgttattttaaattttgcttgtctatactctacagctcatttaataacggaaacaaaaataattgcagggatacggatgggtagctttcaaaacttacatcatcttctgtttcttgagatcaactatttttggagctttgtctcaatcgtaccaaaggataatggtcctactcccttttgcattcttaactttatcttctctacttatttcttttttgggatttttgggggtattattttatcttttgtagatatacacattgatttactataaacgtatactactatccatcttcaactcttcggaatatgatttcgaaaaaactatgaagattaacgggtatcttaaacatgttaagatacaccggacaattttcatttagaagaattgatatgcaattaacaataaatagttgatgatcttttagttttgaagatgtgcgttaagacttaagcgtgtggtaacaaggtgggactcgggcaacgcaaagccttgtagagtccacttgctcaacttgtctttcttttatctcttttccaagtctcaagattcaatgaactccgtgtaacacaaacacgcccatagatgagctcatttttggtatttccaatattgccactccatgataatatcatctagggatggggttcatttattttgaaatctcaacaaatctcgtcgattctaacacacatgattgatttgtttacttacttgaaagttggcaactatctgggattaaaatttatctttttctactgctagctagaagcatctatatatgttagcctaatacgtggaagatgtcattgctaataatggctaaagatgtgtattaatttttcttcttttttccttgaatttttgttctttgacataaactatgctgtcaaaatgtgtagaatctttttacataaatcattccctgttacacactaaaaggttcacaacggacgattgtattggacttccagatcataaaccatgcaaaactgaaaaccacaagaataattagttctaactttagaacgttcgtacgtgtttcatgttcaaaaagcgtcaattataaaagttgggaaattacttttgagttttgacatttctaaggacagtcaaatatgacaacattgggatgcaacttaccttgtattaacttattttgttataaaaccatatattacatattttaaagggttgataaataatcaaatataccaaaacatagcttttcaatatatttgtaaaacacgtttggtctactagctaattatgagaacatttgttcaatgcatgattatctagtatctactagtggattatgaaaattagatattttcattgcatgattatcttccatatatagtgataacatcaaaagaatctacaccaattattgcattttttcattatataataagcactaaactgtaaaattatattcagccacccaaaccatgacaaatcaccttaaaggcttaaacacataacagccattacgagtcacaggtaagggtataatagtaaagaatcaatctatataatatacgacccaccctttctcattctttctggagagtaacatcgagacaaagaagaaagactaaaaaagagaaccccaaaga

SEQ ID NO: 8530 - DNA, 1992 bp, Artificial Sequence
  Maize Ubi 1 Promoter
tctgcagtgcagcgtgacccggtcgtgcccctctctagagataatgagcattgcatgcctaagttataaaaaattaccacatattttttttgtcacacttgtttgaagtgcagtttatctatctttatacatatatttaaactttactctacgaataatataatctatagtactacaataatatcagtgttttagagaatcatataaatgaacagttagacatggtctaaaggacaattgagtattttgacaacaggactctacagttttatctttttagtgtgcatgtgttctcctttttttttgcaaatagcttcacctatataatacttcatccattttattagtacatccatttagggtttagggttaatggtttttatagactaatttttttagtacatctattttattctattttagcctctaaattaagaaaactaaaactctattttagtttttttatttaataatttagatataaaatagaataaaataaagtgaccaaaaattaaacaaataccctttaagaaattaaaaaaactaaggaaacatttttcttgtttcgagtagataatgccagcctgttaaacgccgtcgacgagtctaacggacaccaaccagcgaaccagcagcgtcgcgtcgggccaagcgaagcagacggcacggcatctctgtcgctgcctctggacccctctcgagagttccgctccaccgttggacttgctccgctgtcggcatccagaaattgcgtggcggagcggcagacgtgaggcggcacggcaggcggcctcctcctcctctcacggcacggcagcctacgggggattcctttcccaccgctccttcgctttcccttcctcgcccgccgtaataaatagacaccccctccacaccctctttccccaacctcgtgttcgttcggagcgcacacacacacaaccagatctcccccaaatccacccgtcggcacctccgcttcaaggtacgccgctcatcctccccccccccctctctctaccttctctagatcggcgttccggtccatggttagggcccggtagttctacttctgttcatgtttgtgttagatccgtgtttgtgttagatccgtgctgctagcgttcgtacacggatgcgacctgtacatcagacatgttctgattgctaacttgccagtgtttctctttgaggaatcctgggatggctctagccgttccgcagacgggatcgatttcatgatttttttttgtttcgttgcatagggtttggtttgcccttttcctttatttcaatatatgccgtgcacttgtttgtcgggtcatcttttcatgttttttttggcttggttgtgatgatgtggtctggttgggcggtcgttctagatcggagtagaatactgtttcaaactacctggtggatttattaaagatctgtatgtatgtgccatacatcttcatagttacgagtttaagatgatggatggaaatatcgatctaggataggtatacatgttgatgcgggttttactgatgcatatacagagatgctttttttttcgcttggttgtgatgatgtggtctggttgggcggtcgttctagatcggagtagaatactgtttcaaactaactggtggatttattaattttggatctgtatgtgtgtgccatacatcttcatagttacgagtttaagatgatggatggaagtatcgatctaggataggtatacatgttgatgttggttttactgatgcatatacatgatggcatatgcagcatctattcattcatatgctctaaccttgagtacctatctattataataaacaagtatgttttataattattttgatcttgatatacttggatgatggcatatgcagcagctatatgtggattttttttagctctgccttcatacgctatttatttgcttggtactgtttcttttgtcgatgctcaccctgttgtttggtgttacttctgcag

SEQ ID NO: 8531 - DNA, 1266 bp, Artificial Sequence
  Rice Actin Promoter
tagctagcatactcgaggtcattcatatgcttgagaagagagtcgggatagtccaaaataaaacaaaggtaagattacctggtcaaaagtgaaaacatcagttaaaaggtggtataagtaaaatatcggtaataaaaggtggcccaaagtgaaatttactcttttctactattataaaaattgaggatgttttgtcggtactttgatacgtcatttttgtatgaattggtttttaagtttattcgcgatttggaaatgcatatctgtatttgagtcggtttttaagttcgttgcttttgtaaatacagagggatttgtataagaaatatctttaaaaaacccatatgctaatttgacataatttttgagaaaaatatatattcaggcgaattccacaatgaacaataataagattaaaatagcttgcccccgttgcagcgatgggtattttttctagtaaaataaaagataaacttagactcaaaacatttacaaaaacaacccctaaagtcctaaagcccaaagtgctatgcacgatccatagcaagcccagcccaacccaacccaacccaacccaccccagtgcagccaactggcaaatagtctccacccccggcactatcaccgtgagttgtccgcaccaccgcacgtctcgcagccaaaaaaaaaaaaagaaagaaaaaaaagaaaaagaaaaacagcaggtgggtccgggtcgtgggggccggaaaagcgaggaggatcgcgagcagcgacgaggcccggccctccctccgcttccaaagaaacgccccccatcgccactatatacatacccccccctctcctcccatccccccaaccctaccaccaccaccaccaccacctcctcccccctcgctgccggacgacgagctcctcccccctccccctccgccgccgccggtaaccaccccgcccctctcctctttctttctccgttttttttttcgtctcggtctcgatctttggccttggtagtttgggtgggcgagagcggcttcgtcgcccagatcggtgcgcgggaggggcgggatctcgcggctggcgtctccgggcgtgagtcggcccggatcctcgcggggaatggggctctcggatgtagatcttctttctttcttctttttgtggtagaatttgaatccctcagcattgttcatcggtagtttttcttttcatgatttgtgacaaatgcagcctcgtgcggagcttttttgtaggtagaagatggctgacgccgaggatatc

SEQ ID NO: 8532 - DNA, 2199 bp, Artificial Sequence
  GOS2 Promoter
tctagaatccgaaaagtttctgcaccgttttcaccccctaactaacaatatagggaacgtgtgctaaatataaaatgagaccttatatatgtagcgctgataactagaactatgcaagaaaaactcatccacctactttagtggcaatcgggctaaataaaaaagagtcgctacactagtttcgttttccttagtaattaagtgggaaaatgaaatcattattgcttagaatatacgttcacatctctgtcatgaagttaaattattcgaggtagccataattgtcatcaaactcttcttgaataaaaaaatctttctagctgaactcaatgggtaaagagagagattttttttaaaaaaatagaatgaagatattctgaacgtattggcaaagatttaaacatataattatataattttatagtttgtgcattcgtcatatcgcacatcattaaggacatgtcttactccatcccaatttttatttagtaattaaagacaattgacttatttttattatttatcttttttcgattagatgcaaggtacttacgcacacactttgtgctcatgtgcatgtgtgagtgcacctcctcaatacacgttcaactagcaacacatctctaatatcactcgcctatttaatacatttaggtagcaatatctgaattcaagcactccaccatcaccagaccacttttaataatatctaaaatacaaaaaataattttacagaatagcatgaaaagtatgaaacgaactatttaggtttttcacatacaaaaaaaaaaagaattttgctcgtgcgcgagcgccaatctcccatattgggcacacaggcaacaacagagtggctgcccacagaacaacccacaaaaaacgatgatctaacggaggacagcaagtccgcaacaaccttttaacagcaggctttgcggccaggagagaggaggagaggcaaagaaaaccaagcatcctcctcctcccatctataaattcctccccccttttcccctctctatataggaggcatccaagccaagaagagggagagcaccaaggacacgcgactagcagaagccgagcgaccgccttcttcgatccatatcttccggtcgagttcttggtcgatctcttccctcctccacctcctcctcacagggtatgtgcccttcggttgttcttggatttattgttctaggttgtgtagtacgggcgttgatgttaggaaaggggatctgtatctgtgatgattcctgttcttggatttgggatagaggggttcttgatgttgcatgttatcggttcggtttgattagtagtatggttttcaatcgtctggagagctctatggaaatgaaatggtttagggtacggaatcttgcgattttgtgagtaccttttgtttgaggtaaaatcagagcaccggtgattttgcttggtgtaataaaagtacggttgtttggtcctcgattctggtagtgatgcttctcgatttgacgaagctatcctttgtttattccctattgaacaaaaataatccaactttgaagacggtcccgttgatgagattgaatgattgattcttaagcctgtccaaaatttcgcagctggcttgtttagatacagtagtccccatcacgaaattcatggaaacagttataatcctcaggaacaggggattccctgttcttccgatttgctttagtcccagaattttttttcccaaatatcttaaaaagtcactttctggttcagttcaatgaattgattgctacaaataatgcttttatagcgttatcctagctgtagttcagttaataggtaatacccctatagtttagtcaggagaagaacttatccgatttctgatctccatttttaattatatgaaatgaactgtagcataagcagtattcatttggattattttttttattagctctcaccccttcattattctgagctgaaagtctggcatgaactgtcctcaattttgttttcaaattcacatcgattatctatcgattatcctcttgtatctacctgtagaagtttctttttggttattccttgactgcttgattacagaaagaaatttatgaagctgtaatcgggatagttatactgcttgttcttatgattcatttcctttgtgcagttcttggtgtagcttgccactttcaccagcaaagtttc

SEQ ID NO: 8533 - DNA, 1358 bp, Artificial Sequence
  Ubi-1 Promoter
gtgcagcgtcgcgtcgggccaagcgaagcagacggcacggcatctctgtcgctgcctctggacccctctcgagagttccgctccaccgttggacttgctccgctgtcggcatccagaaattgcgtggcggagcggcagacgtgagccggcacggcaggcggcctcctcctcctctcacggcaccggcagctacgggggattcctttcccaccgctccttcgctttcccttcctcgcccgccgtaataaatagacaccccctccacaccctctttccccaacctcgtgttgttcggagcgcacacacacacaaccagatctcccccaaatccacccgtcggcacctccgcttcaaggtacgccgctcgtcctccccccccccctctctaccttctctagatcggcgttccggtccatggttagggcccggtagttctacttctgttcatgtttgtgttagatccgtgtttgtgttagatccgtgctgctagcgttcgtacacggatgcgacctgtacgtcagacacgttctgattgctaacttgccagtgtttctctttggggaatcctgggatggctctagccgttccgcagacgggatcgatttcatgattttttttgtttcgttgcatagggtttggtttgcccttttcctttatttcaatatatgccgtgcacttgtttgtcgggtcatcttttcatgcttttttttgtcttggttgtgatgatgtggtctggttgggcggtcgttctagatcggagtagaaatctgtttcaaactacctggtggatttattaattttggatctgtatgtgtgtgccatacatattcatagttacgaattgaagatgatggatggaaatatcgatctaggataggtatacatgttgatgcgggttttactgatgcatatacagagatgctttttgttcgcttggttgtgatgatgtggtgtggttgggcggtcgttcattcgttctagatcggagtagaatactgtttcaaactacctggtgtatttattaattttggaactgtatgtgtgtgtcatacatcttcatagttacgagtttaagatggatggaaatatcgatctaggataggtatacatgttgatgtgggttttactgatgcatatacatgatggcatatgcagcatctattcatatgctctaaccttgagtacctatctattataataaacaagtatgttttataattattttgatcttgatatacttggatgatggcatatgcagcagctatatgtggatttttttagccctgccttcatacgctatttatttgcttggtactgtttcttttgtcgatgctcaccctgttgtttggtgttacttc

SEQ ID NO: 8534 - DNA, 1321 bp, Artificial Sequence
  rbcS Promoter
ccaagagtcgttgtctccatgacaacgcccccaaggaggaaatcgacgtaaaaacgccgttgtcgcccgatctggccatagccaaatcttaggttttcacccgaagacaccaaacatcaaagtgagggaaagtgaagctcttcgacgacacctccaagaaggaaaacggcgctacaacatcgttgtcttcggcatacctcgcacacgggcagttttcatccagagcaacactccaaacaccggagccgacgtccatacctcgcacacgggcagcagccgaagacgcgaccgaaaatgaaaaccacgccaccatggcatcgaaaaggaccgacttggaccatgtatggccgcagcagcagcccatctgccgccggtgaagttcaatcagccgcctcaccaaactgagaggaaaaatgatggaaacgaagagacctgggacatgccggatcagccggaggagatgacggatctggccaacgagtagctagatccggccgaagagcgccgccgtgaagccgcgcagccacgagcagaccgagcaccagggagaggaagaacgaggggaaacaccggatccgggaggaagccggccggatctagccgaagacgaggcatagcctgccggatcgggccggagacgccgcgaccacgatgaggcagcacctcaaacgcctcagccaagagctctaggacacccccgccaagaaaaacagccccgccgccgccgtccccgtgcgggctttgcccggcggcggcgagggggaggagaggacggggagaggctgctgccggggctggtgtggttgccgcccgtgtcgccccagactgagcgacgcgggggcaagcttcgttctcgataagatcttagaagagtttctcttaatttgttgttcctctagttcataaaaagtgctgctcattttgcattaactcattacaaattttctaataagtgggcgagattttttatggattggagggattagcaagttctgtttttgagtgcatgccgtggcacattggatctatcctgataggtgaaaattggtcacttcatggcatgatttgcagagtgcgttgcagccaattgtatccgtccagaggataacgcgcgccatttcgtgcggccatgtggcgcccgacctgatccgtaggatgccagcgtggcctgggcaaatccgcgcggcgaactgcagccacccctcctagatcttgtgctgatattggatgggtggggagcctacagttatataagccgctgtagctagagagcactcaagcaagcctgcctcctcttgttagctatctacgtacgtgtacg

SEQ ID NO: 8535 - DNA, 1599 bp, Artificial Sequence
  AT5G06690 Promoter
ggaccatttgtttagacgacattgttaaggggatgacttaaagtgatgagtttcaaattaaaatacccctcgtttttggagttatttacttaaaatgccacttcaaagaagcgtgtcggtgtgttcgagattcgaattttaattactgtcttttgcccctatctatatatatctcactttaatcacacttttattatcgttaatgtttaatgtttatttatgttaatgaaggattagtggttagtggttgtgttactaattgttcgttgctaatgtccttgaaaggtgtaatttgtatgatctatctaactaaattatccggaaataatgcggttgaaataaaatcacgatacatattaggatatcacaatctatttatagtatattttagtcgagatttgaaaataaaaagggaatatattactcgattaaagacattttcaaacgcaaaatcgtatataactatagattgaatcatatatatatctgtgactcaagtcttttatctttgttttttggtttaatgttaaaactttatatcaacaaagacttttatcttgtatcttatgtttactatttctgatgagtaaatattaattttgtaggtaagtaaggtggcaggtttgggtaaagaggaaatcaaaaatgtatggtaggatagtacttgacaaaatacaaaattctaattcgcgtttattaaagtccttagcgtgtggactctacttgtttaatttcgactctctaaacgtcggcctttattttctttcaaacgtacttcaccaactctattagagagatcgattataaccgacaagcataagtatgtgatttctatattagtttatatatagctatgtcttcgaatgattatttatagtaaacacataattatacgtaataagtccgagagtatataaactatgaaggataattaattgaagacaagaaaattaacgaaatagtgtggggaattcccaaggcatcatattcagatcaatgcaccgtcacaagtttggctattctttatttggttttctgattaacacaaagttttaaatagttttgaacgtttctaatccatttgaggcagtgattttttctgttccaagtattttatgttcaatattattaggaatgtgaacggaacgatttttttttttttttgtggaaccgagcgaccaaatttgagaaaataaaacaaattagattgatttaacatttagacgaggtttaattagaaaggaaaaaaaaaacacaattttatataaatatgaacagccaaaataattttcctagagtttataagttcagggtttacctttttcatagagaaaactaataaagtcactattaacattttaagaatatacatttttaaaacaaattataaagacaatgagagaaaggtagcccccaccagtagcacatcgttggcattgtccaactcatcttccggataagctctctatccatctcctcacatctcttcccaaaactttcaaaaacaaaaaaaatatcttaattatggcatttgaaaacttaaaaatatctcgtcacatatcttcatcgacaaaaaatttactgaaagcgaaaaaaata

SEQ ID NO: 8536 - DNA, 1774 bp, Artificial Sequence
  AT5G61520 (AtSTP3) Promoter
ctgttatgaggtgttcttgcacggcatgtctagttgcaggctgctgaagaattgcccaccggcttttaaacaacgacccaactctttctgcaacatctgcaacattcactttcgcatccttagcaacttccccgacaaaactaccagcagtctgccctgcttccctaagcttcgttcctaattcagtaactccatagtaagctttccaccataaacactcacagagagaaacgaaatgaggttagcatagaaattatcaaacctgatgaagaaaagaatccactagtcctctcctgccattgctgtgagatgagagaaggcattatccaataccaaccactttaaacaagtcactagaaacctgtttgcatcaagaaacaaatgggaagatatatacttattcttagcaaattatgatacaacctcacaagcggtattatccgttgtaatcaacttcatcacatgaaatcatcttcaatctaatcatatacaattgatacagaagaaacacaaaagaaaaccaaaaccttgacttcatcgtcaaccatggaatgaatttcttgacaaagaataaaaaccaagtctttaactgccaaaaggagataacttttaaggaacacaaaccctaatcctatattctctaatcaatcatatacgagaatcaaaaagaacaaatagaacaaaagcaatccgatcatcaaacctttagaacaatccccagaaaaattgagatagctgatgatcgaatcgaactaaacccaattcctcgatacgatcaaagacgacgaagacgagagtcagcgatatgatgaaaaagaaattgatcgctccaggagatgaaaaggttccacttttttaatttccccctggagcagagaaaaaaagatattattgctgtttaggtaaaaaaaaagtcggctttgaattttgaataggaaagtcttcttccctttgcaaatcacagatattctctccgtcacggactgtgacggtaataaatattctgttggtgccacgtgtaataagtttttctcttcacaaaaatggtccttcatcttcttttagtatctcatttgtgacctaagcttctaatttcacagcttatcatccccttaatgttttaagttttttgaccatagagtaaaattattttactataaaattaaaagcaaaaaataaaatttactataaaattataattataaaaagtgaatgtaaaaatgattccataaatttacatgattgatagtaattattctgccaacttaattccacatgtatatcagtatttatatatagaaaatgatggtttttctacatagtcaaattccaaaacaaaatatcagtattatggaattaaacaatcaaagtttgcaacttggtatgtccaatatcatcgaaagagctttatcattcagtcgttgaaaaaagtatagccatctttttcttctatcgattttcaaaaaaaaaaaaaaaaaaaaaaaaaaaaaaaaaaaaaaaaaaagaggaagataatgaaggtaggcagtgaaaagtctttcttcacatgtcttttattgtccactttcgatatctcatcagccagaaccgaaacaaacaaaaactataagtcccacactcaagtcaattaaagcactccaatggtccaacaagtttcgtcgtctaccttgaaactcaacctttggatgattgatatacaaaaatacaggatctaaaaacacctaccgaacttgaatagtaggtgtgttgtgtttgagtgtctctctaggtaaac

SEQ ID NO: 8537 - DNA, 1127 bp, Artificial Sequence
  NAPIN Promoter
attgattcctttaaagacttatgtttcttatcttgcttctgaggcaagtattcagttaccagttaccacttatattctggactttctgactgcatcctcatttttccaacattttaaatttcactattggctgaatgcttcttctttgaggaagaaacaattcagatggcagaaatgtatcaaccaatgcatatatacaaatgtacctcttgttctcaaaacatctatcggatggttccatttgctttgtcatccaattagtgactactttatattattcactcctctttattactattttcatgcgaggttgccatgtacattatatttgtaaggattgacgctattgagcgtttttcttcaattttctttattttagacatgggtatgaaatgtgtgttagagttgggttgaatgagatatacgttcaagtgaagtggcataccgttgtcgagtaaggatgacctacccattcttgagacaaatgttacattttagtatcagagtaaaatgtgtacctataactcaaattcgattgacatgtatccattcaacataaaattaaaccagcctgcacctgcatccacatttcaagtattttcaaaccgttcggctcctatccaccgggtgtaacaagacggattccgaatttggaagattttgactcaaattcccaatttatattgaccgtgactaaatcaactttaacttctataattctgattaagctcccaatttatattcccaacggcactacctccaaaatttatagactctcatccccttttaaaccaacttagtaaacgctcttttttttaattttatgaagttaagtttttaccttgtttttaaaaagaatcgttcataagatgccatgccagaacattagctacacgttacacatagcatgcagccgcggagaattgtttttcttcgccacttgtcactcccttcaaacacctaagagcttctctctcacagcacacacatacaatcacatgcgtgcatgcattattacacgtgatcgccatgcaaatctcctttatagtctataaattaactcatccgcttcactctttactcaaaccaaaactcatcaatacaaacaagattaaaaacatacaccc

SEQ ID NO: 8538 - DNA, 916 bp, Artificial Sequence
  AT1G61720 (BAN)
ttgtacttttgaaattacagagatagagatttagttgttatgagtttatcgtcttgagacttctatataagaagtaaaaagatttgcaaatagtccttgctcattaggtacaacagtagatcaataaggctgttttagaaggtaagcacgtgatctttgaaataaccaacttgtcttcacctaagaatcaaaaaagattgaccttcagagttctgatttgttatcatctaccaaattatcacaagagtttgattatttctgtctctaaacaatataacacagctttagagtaacgaatagtgttacagtaaggttctgttacttcaattttttctttgccgatcttaaaatgagttgcaaaagaatgctttttacttccaccaatctgtcaaattctctgcagtttttaacacaacttggacttgctatgttctgtttcacgaattacacgagtcaattcaacataacttgctctgttcttgtccatgtttcacagaatctggccttaagcaattttatcatatttaagctacaaatccataacagagtttaacaaagataaaataaccagaaagttacattgaaagataaaaagtgaagaagacaaaaaaaagagagggtaaatcctaaatcgaaaacaaaagaaggcattggcaatagcattccgattttaaaaaaccgataaatctatgtatctaatggcttgttcttagaagcttcaacgaacatagaagcaacctcattcaaaaacttagtcttctccaacacaaattccaactccttagcttgcaacaacttatacttctcttcaacaatcttcttactctcaaccgaaaccaaactccattgctgcttcacataatactcatcaacacccaaactagcaatcatcctaacaagagacgagttatcaaac

SEQ ID NO: 8539 - DNA, 4119 bp, Artificial Sequence
  AT3G24650 (ABI3)
catgttaagttttactagatacgttctcatctaactagatacgacctaaaatacgatatttgtggttttagttgttagatgttgtgtcacacgagagaaagaggtcgacgaagaaaaaaacaaaaagaagaagtaaaacgtagttattggcggacaagggataaagattgctttgaagtcagaaatgctgacacgtggcagcatatgaagacaacccgccgcttaaaaccacgaatggtgacgaaaggcttctttgtttgcatgtgcaaccaatctctctctttctctctgtctttactaattttggttgttcgtagaaaatgaaatatttgaacgaagaagataaaggttggtgatgtacgtatgactctaaattagagtttgataatttgtatgtaagattagatcggttttgttatttgcttgatccaatttattgaagtacatgtgaataatcgtgatatatgtcaatatatatgtgctataattaaatctattaacaaatttctttttatcgatttagttacaccatctttaatatatttctattttctattttaaactaaagcatagtttctccaatatattaatttatatatttactctaggatagaattagattcaaaaactagaatagagaatatagatgctctaaatagacaataattctattacttactctattttagagtaaaacatatagtgatgctgacaaaaatattattttataatagagtttagaaagaaaagaaaaaacaaaaaaaacttgaagatgctggaactattaaaaattaaagaaaaagtttaaaatgaataatgctttttattcttagttttttttttcttttttttcttttagttgatgttaaagttttagtcaaatctccaaaatttgcaaaaaagatacattagttacggacggatatatattaaataaattaagtcacaaatatcatatatatatatatatatattaattttttgcctagttttgttccaaataaaattttcaatttttagtgtacaatatttttcatcgtccaaatacacaaacacaacaaataataataccactaatttatttgttttctaatataattgaaccttttctaattttattaaataggctgaaaaccataaattatttggagccaagattaaattatgttacataaatccttttctcgtcatcaatactcaaatttaaatttttttattttcatagatatttttgggaatttaaaatccttccaaataaatttgggaaaataatagatgttttaaaatatttttgttattttcgagtagtttacactgattttacatcactttatggatcaagaccataaaatttaactacatttattataacttatttgaaaagacatgaaactttcattagagtttaggaaaatacggcaaactattagattatcaccctcttgtgactaatgttaatactatttggtaaagcaaataatcccataactaattttattttgatttgttcactatcaattgtatcatagacgatccgatgattaatgtacctaaattttgatttaaattgtattccttgtagtacgcatagtaaaacaaagttcacatgttcttttacaattggttttctaacattttagatttcattttaaactaaagaaaaagggtttttcgatcccaacaatttttaaagtatgtttttgaatttcaacaaacgactagtactgatatatacatcaatgcttacaaaaatcaaattatctatctcaacgtttacttttgtacgtaattacaagtcaatattaacaaatattagtcaactgtaacggttgttgactcaattgatacgtgtacgtttaggtggcatgttttttaataaaataattttgttttatgttttgggattaaaaatatttacttttaaaaaactaaaccgaaaaactggaacccccaacctcacatattcatcaccatcgtatccacaaacattatcgagacataaataataatttatagatatatagcaacaaattggaattaaattaatcaaacaatgtcatttagaattggggaaatcctaaccgacgttatatgattaattttaattccaatttatgtatgtgtatatatctataaattattatttatatattgatgatgttcgtgcatgatggtaatggtaacctttaaaacttttgaatctcaaaacgtaaaacaacgtcatttggtttgaagaacatgccatctcgacgtacaagtgttagctgattcaacaaccgttactgttaattaccataactaacgttgactcataattatgtacaaaagtaagagttgaggtagataatttgaattttttaaatgttaaagtatgaacattactaattgtttgttcagatttataaaacacagtacctattttgatgtgttaaaatgtaatcgggaaaataggaattttcccaagaaaaaaaaatacactaaaattttgatgtgttaaaatgtaataaatacaagtacctatttctttctacaacaggtatcacatgatctgctcaatctcattttgaaggcaaggtcgaaccctgtttgtaactaaatattttacaaatacactaaaagttttgttttgttttcctcatgcagaaaaaagaaaagaaagaagaagaaaaaaaactcacaaaaacatacattgttctacaatatgttaaagtaattgttctagggtaataaaatccgtgtctgcctcttccacttcaataggaaagtgtaagtttttcgaatctttttggccagataatttaaaaccgaccgaggaaacttacttttgtaaaagtgaccatttgcacataggaagtagaaagttgataattggaaaatttataatattttatacaaaagaagtgtttaagaaccaccgcttggtctcaccactcaaattcgaacgtatggctcgtgggcacaaactcctgtaccaacctttagatactagcggcacgaggagacttctattttctctttgtttttaagtttttttatcgacttaaatatggctttttgcaccatttaatttcaaaaccaatgtctttctctcgaggaactttgtttttatttcttagaagatgaggggagatttactatctaaataaaattttaaatgtttgtaagtattatgagctcaacaattttgtcaatagtgccacaaatttaaacgtttgctttttgtcttctttgaaaaatcaaatgctgaaaaactgttacatctctttttcttaaaaactcttgtctctctccttttccttctgctgaggtaattgaatgctgcaaagagaaagagaataacttaaacccaaaattacacttaccgccagaaaaaaaaaagagttcagtttaatctaacatattttatacaatacaattgaattatattagtaaaaaaaaaacttccatataaatcatggaacaaactggaacacatgggctctcttattttaatttattttcttttttgagggatttaaccatgtttattatatagttttataaatatatatataccatctctccataatttataaaatgaaagaaagagagagtcttcttgttggagtaaacccaaacggttttagattacttattagctgttcatcagttcttcctctctaaaagagtaaaacctaaacatctctctctgttctattagaaccaaagaccaatctttgtgaacaaaacacatctcgtatacttcagatctagactcgaaaattttagacctctttacaattggtctttgttcatctgaagttggagaaaatagttagcttaggtcggatcttttcatatgctttggatcctccttcgtctcttttgtataattttaaccttatcaagagttctttttgaatctcaaaagattatatagtagtatagaaggtttatatgtatatgtatagccagatagtttatgttgtttaaagattcgatgatagccaagttgggttaactttctttttccttgcctccttactcacatacaaaccctatctgtccgtacaaaatactaaaaaccctaacttttctctctccaccaatctagtttattgtttcatttccacttcaacg

SEQ ID NO: 8540 - DNA, 1700 bp, Artificial Sequence
  AT1G69120 (APETALA 1)
ttagactgatttctctatacactatcttttaacttatgtatcgtttcaaaactcaggacgtacatgtttaaatttggttatataaccacgaccatttcaagtatatatgtcataccataccagatttaatataacttctatgaagaaaatacataaagttggattaaaatgcaagtgacatctttttagcataggttcatttggcatagaagaaatatataactaaaaatgaactttaacttaaatagattttactatattacaattttttctttttacatggtctaatttatttttctaaaattagtataattgttgttttgatgaaacaataataccgtaagcaatagttgctaaaagatgtccaaatatttataaattacaaagtaaatcaaataaggaagaagacacgtggaaaacaccaaataagagaagaaatggaaaaaacagaaagaaattttttaacaagaaaaatcaattagtcctcaaacctgagatatttaaagtaatcaactaaaacaggaacacttgactaacaaagaaatttgaaacgtggtccaactttcacttaattatattgttttctctaaggcttatgcaatatatgccttaagcaaatgccgaatctgttttttttttttttgttattggatattgactgaaaataaggggttttttcacacttgaagatctcaaaagagaaaactattacaacggaaattcattgtaaaagaagtgattaagcaaattgagcaaaggtttttatgtggtttatttcattatatgattgacatcaaattgtatatatatggttgttttatttaacaatatatatggatataacgtacaaactaaatatgtttgattgacgaaaaaaaatatatgtatgtttgattaacaacatagcacatattcaactgatttttgtcctgatcatctacaacttaataagaacacacaacattgaacaaatctttgacaaaatactatttttgggtttgaaattttgaatacttacaattattcttctcgatcttcctctctttccttaaatcctgcgtacaaatccgtcgacgcaatacattacacagttgtcaattggttctcagctctaccaaaaacatctattgccaaaagaaaggtctatttgtacttcactgttacagctgagaacattaaatataataagcaaatttgataaaacaaagggttctcaccttattccaaaagaatagtgtaaaatagggtaatagagaaatgttaataaaaggaaattaaaaatagatattttggttggttcagattttgtttcgtagatctacagggaaatctccgccgtcaatgcaaagcgaaggtgacacttggggaaggaccagtggtccgtacaatgttacttacccatttctcttcacgagacgtcgataatcaaattgtttattttcatatttttaagtccgcagttttattaaaaaatcatggacccgacattagtacgagatataccaatgagaagtcgacacgcaaatcctaaagaaaccactgtggtttttgcaaacaagagaaaccagctttagcttttccctaaaaccactcttacccaaatctctccataaataaagatcccgagactcaaacacaagtctttttataaaggaaagaaagaaaaactttcctaattggttcataccaaagtctgagct

SEQ ID NO: 8541 - DNA, 1096 bp, Artificial Sequence
  RootP Promoter
tcagatgaagaaggcggcttttgcacgatttcataatggctacgtatttggcagataaagttattgtgtatgaaggagaaccttccgtggattgcacggcatcttctcctcagtctctacgtagtggaatgaatttgttcttgtctcgtttgaacatcactttcagacgagatcctacgaatttcagaccaagaatcaataaactcgattcgatgaaggatagtgaccagaagcttgcgggatgttattactacttggatgattaagagagagatgacattgagagaatctttcaccggagaaaacctgaagtagtgagaaactcacgttttgatctttcctagccccttcaatctattataagatctcttgaattttattagatccatctggagtttaatttttgagaatatattatggtgtttgaattcggtttgtttcaatcgttcccatatattagactagtttttttcttcacacatgagaatctcaaaccgattgcgtagaagaagaactcgcattcatctgtttttgtctttagttgagaatgaatgaccgttgtaatgtcatgggcttcttttggtttgggtctgaatcacttaagcccaacacaatctcttcttaggttgaaacactgttgtttttgctgttttgtctgacacaaggcatcggatgatgtcgattgtcgaatatgcttcctcattcggagtgttctcagacatcttgagcttctcattagttaggcggtgcgctcgaaagtcgaagccgtgttgacatatcaaaacattgggaccattcaattttgtacaaatgtccaaacattatttcggtttgataacaataaacaaataaagaaagagttttttattggattcacttggcaacagccaacaacgaatcaaataatctatatacataattatattagaagctgtgaatgtgcctccgagtagacaaaagcacatgcaccataaatgatcaaacccatgaaacttccatctctctttttcccctatataaactaatgtcacttacctcaatattccatcaacaatatacatctgagatatcaaaactcctagagagatctaataaa

SEQ ID NO: 8542 - DNA, 2103 bp, Artificial Sequence
  Pho1 Promoter
actgtttaaggacaaaaaatgtggaactgatgtctcctaggtggtggaatatgtgaagctagaaaacaaataaatgcggtccgactcagaccatcattttcctcttgtctcattggttttaaaattaaatattatattataaaatctgttgcagtattttttttaatctcaattagagttatttatttaggtctcaacccatggtggggaaaaaaacagctattttaggtaaatttagattacaaaattgtatagtcaatatcaataataggttaaagttttaataaactgggtgaatcagtttttgtttggtcttcttggatctttgtttggtctcaatattttggattacatataaattccatcccgactattatttgggttttgccgctggactctataacacactgattttagttttatatgaattttacgttgttttacgtttgatcatgaactaaaaattcagcaatccataagaaaatattttttggactagttcgaaactcggccagacaatactaaacctattcacatatttaactttttttttttttggacaaacataattaactttagtaagtgttatatttttgtcaatattaaactagatgtggtgtttttaattgtgggaaataaaattaaagaagcaaagttccatgaaatatggactttccgtaattggaaggccgccatatgttgccttcatttgtattttccttttattgacccttttgttttcttataagataaatatatatataactaattaggcagaagctgagtggcattagttagtgaaatatatttatcattatcccaaattcctctagctgacattactttgaatttagaaatttcttatccgcaaaatttgtactaatattatgaagtagtacatcgaatagaatatatattggtgcacattatgatccactttcaatgccatccattcgaatggttgctcagaacgtacttgtagaaaccgcgtgcataaagtttcatatgagcatcgtgtgctttgttatttaattttttcttccctaaataatcagacagaaaaattcataaacttctttaataaaaccatccaaaaggggattatactacgaaaattatggcatctaaacgcaaagtttaatatatttttagtaccaatgcattgtaaaagaatggaaattaaataaaaacaatatgaaactgtttgttcccttggacaaaaaaaaaacttggtatgactatgatttttatatgcgcttttgtaattgcattgtaattttgtcgatatggaagtggattttaaagaacattaatccatgatctgataggtgaaaactcacactacttgactgctatataacatggtttggtagtatctgcatttgtaatgtgaaactatgaaatcagaatttgattggtaattcttcttctgcttcttttttcttgattctttaagatttagtatgtgtttcaaatttttcattgtcctccgaaaaaatgtagtggaaatcgagctggtccaatctaagttcactcaccttttgtgtctcttggcacctaatttctttttggtccatttcagctatcttcttccttttccacacaaaacattacaaaatacttactatttctagttctccgatttacaatacccaaattacccttacccttgcccctcatatagttcgtataacaactttcactctaagatgaaacattttgagtgttgagaaaggtatatgaagctcggtagccggaggaagcacggtggatatacactggcgagaatcaggacggtcccacacgagacaagatttacctctcccaaaagcacaagtggaaggagcataggataaaaattagtacatgaaattaggtttcaagaaggatatttgagaatgtgctttgtgaggcatcgtcagtaggagtaagcaatccagtcaaatatattcttctttttttctctgcctttgcttttgtccactataaaacaaatctcatcctcctctcttgccctacactcacaaaacaaacacactctcttcttgatcattttctcttttgagtttttgagtttaaggacttaaaagagaaaacgctatg

SEQ ID NO: 8543 - DNA, 277 bp, Artificial Sequence
  NOS TERMINATOR
gagctcgaatttccccgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgggaattc

SEQ ID NO: 8544 - DNA, 29 bp, Artificial Sequence
  Single strand DNA oligonucleotide
aaaggatcctatatacggacggcgcacac

SEQ ID NO: 8545 - DNA, 31 bp, Artificial Sequence
  Single strand DNA oligonucleotide
aaagaattcgctatattggctagcagcaagg

SEQ ID NO: 8546 - DNA, 27 bp, Artificial Sequence
  Single strand DNA oligonucleotide
aaagtcgactcgtcctgcacgttgatg

SEQ ID NO: 8547 - DNA, 31 bp, Artificial Sequence
  Single strand DNA oligonucleotide
aaaggatcctctgcatctcctcttctggttc

SEQ ID NO: 8548 - DNA, 28 bp, Artificial Sequence
  Single strand DNA oligonucleotide
aaactcgagcccacaaaccctagcatcc

SEQ ID NO: 8549 - DNA, 31 bp, Artificial Sequence
  Single strand DNA oligonucleotide
aaaggatccccacgctctaccatcaaacttc

SEQ ID NO: 8550 - DNA, 31 bp, Artificial Sequence
  Single strand DNA oligonucleotide
aaaggatccaaacacacaggaagctcctagc

SEQ ID NO: 8551 - DNA, 26 bp, Artificial Sequence
  Single strand DNA oligonucleotide
aaagtcgactccacggcgaaaggcat

SEQ ID NO: 8552 - DNA, 26 bp, Artificial Sequence
  Single strand DNA oligonucleotide
aaaggatccccgccatgtcgtccgcc

SEQ ID NO: 8553 - DNA, 28 bp, Artificial Sequence
  Single strand DNA oligonucleotide
aaaggatccggtatccgcactgcatctc

SEQ ID NO: 8554 - DNA, 32 bp, Artificial Sequence
  Single strand DNA oligonucleotide
aaaggatccagctcaggaacaacacactcttc

SEQ ID NO: 8555 - DNA, 31 bp, Artificial Sequence
  Single strand DNA oligonucleotide
aaagatatcctaccaggtcccaactcaagtc

SEQ ID NO: 8556 - DNA, 27 bp, Artificial Sequence
  Single strand DNA oligonucleotide
aaagtcgacgggtttgatttggaggcg

SEQ ID NO: 8557 - DNA, 27 bp, Artificial Sequence
  Single strand DNA oligonucleotide
aaacccgggttgcctttcccaccactg

SEQ ID NO: 8558 - DNA, 27 bp, Artificial Sequence
  Single strand DNA oligonucleotide
aaagtcgaccaaagcagcagctcgctc

SEQ ID NO: 8559 - DNA, 31 bp, Artificial Sequence
  Single strand DNA oligonucleotide
aaaggatcccggttggagatttgattgtctc

SEQ ID NO: 8560 - DNA, 28 bp, Artificial Sequence
  Single strand DNA oligonucleotide
aaaggatcccgtacggcagatccatcac

SEQ ID NO: 8561 - DNA, 30 bp, Artificial Sequence
  Single strand DNA oligonucleotide
aaaggatccgtctctcctcgtctgatctgc

SEQ ID NO: 8562 - DNA, 31 bp, Artificial Sequence
  Single strand DNA oligonucleotide
aaaggatccaagagcaagaagacacgactgc

SEQ ID NO: 8563 - DNA, 30 bp, Artificial Sequence
  Single strand DNA oligonucleotide
aaaggatccctgcaaagttactggtggtgg

SEQ ID NO: 8564 - DNA, 31 bp, Artificial Sequence
  Single strand DNA oligonucleotide
aaagtcgaccttgctcccatattaagcccag

SEQ ID NO: 8565 - DNA, 26 bp, Artificial Sequence
  Single strand DNA oligonucleotide
aaagtcgacccaccatggctgcggcc

SEQ ID NO: 8566 - DNA, 30 bp, Artificial Sequence
  Single strand DNA oligonucleotide
aaaggatccgctaataacaatggcctctgc

SEQ ID NO: 8567 - DNA, 31 bp, Artificial Sequence
  Single strand DNA oligonucleotide
aaagtcgacaaacagcagaattgagccgtag

SEQ ID NO: 8568 - DNA, 29 bp, Artificial Sequence
  Single strand DNA oligonucleotide
aaactcgaggttccatgtacggcatttgt

SEQ ID NO: 8569 - DNA, 28 bp, Artificial Sequence
  Single strand DNA oligonucleotide
aaaggatcctggagtggttggtgctcag

SEQ ID NO: 8570 - DNA, 31 bp, Artificial Sequence
  Single strand DNA oligonucleotide
aaaaggcctgccacttagccactagacaacc

SEQ ID NO: 8571 - DNA, 31 bp, Artificial Sequence
  Single strand DNA oligonucleotide
aaagaattcgtgctgtttaatgcaagtggtg

SEQ ID NO: 8572 - DNA, 29 bp, Artificial Sequence
  Single strand DNA oligonucleotide
aaaggatcccccaccacaacctagtctcc

SEQ ID NO: 8573 - DNA, 31 bp, Artificial Sequence
  Single strand DNA oligonucleotide
aaaggatcccaccttctcgctacacaaacac

SEQ ID NO: 8574 - DNA, 26 bp, Artificial Sequence
  Single strand DNA oligonucleotide
aaactcgaggtggtgcccatggcgtc

SEQ ID NO: 8575 - DNA, 31 bp, Artificial Sequence
  Single strand DNA oligonucleotide
aaaggatccctcaagccttctagcctcacag

SEQ ID NO: 8576 - DNA, 33 bp, Artificial Sequence
  Single strand DNA oligonucleotide
aaaggatccgcttagagcttgtctctcctctcc

SEQ ID NO: 8577 - DNA, 28 bp, Artificial Sequence
  Single strand DNA oligonucleotide
aaagtcgaccagatcaccatggacctgc

SEQ ID NO: 8578 - DNA, 31 bp, Artificial Sequence
  Single strand DNA oligonucleotide
aaactcgagataacgtcaccattcttcctgc

SEQ ID NO: 8579 - DNA, 30 bp, Artificial Sequence
  Single strand DNA oligonucleotide
aaagaattccactcttcccaagttcccatc

SEQ ID NO: 8580 - DNA, 31 bp, Artificial Sequence
  Single strand DNA oligonucleotide
aaaggatccctaacacaacggaggcaatagg

SEQ ID NO: 8581 - DNA, 31 bp, Artificial Sequence
  Single strand DNA oligonucleotide
aaagtcgactacgtgtgcttctcatctcagc

SEQ ID NO: 8582 - DNA, 30 bp, Artificial Sequence
  Single strand DNA oligonucleotide
aaaggatccacccactaaactgccactctg

SEQ ID NO: 8583 - DNA, 28 bp, Artificial Sequence
  Single strand DNA oligonucleotide
aaaggatccgaagcgaaacagcctctgg

SEQ ID NO: 8584 - DNA, 28 bp, Artificial Sequence
  Single strand DNA oligonucleotide
aaagtcgactggtaccaccacacacagc

SEQ ID NO: 8585 - DNA, 31 bp, Artificial Sequence
  Single strand DNA oligonucleotide
aaaggatcctgtgtcttggtaaacatcggtc

SEQ ID NO: 8586 - DNA, 29 bp, Artificial Sequence
  Single strand DNA oligonucleotide
aaagtcgacgatccttcctccaccaaacc

SEQ ID NO: 8587 - DNA, 27 bp, Artificial Sequence
  Single strand DNA oligonucleotide
aaagatatcagggaaagcaccgaaagg

SEQ ID NO: 8588 - DNA, 31 bp, Artificial Sequence
  Single strand DNA oligonucleotide
aaaggatccctgcatcttctccctcgttatc

SEQ ID NO: 8589 - DNA, 28 bp, Artificial Sequence
  Single strand DNA oligonucleotide
aaagtcgacaagctccatcccgttcttg

SEQ ID NO: 8590 - DNA, 30 bp, Artificial Sequence
  Single strand DNA oligonucleotide
aaagtcgactccagagcactcactctcctg

SEQ ID NO: 8591 - DNA, 30 bp, Artificial Sequence
  Single strand DNA oligonucleotide
aaaggatcccacaggagtgcagaattgacc

SEQ ID NO: 8592 - DNA, 31 bp, Artificial Sequence
  Single strand DNA oligonucleotide
aaagtcgacgcgttcaggctatgaactaagc

SEQ ID NO: 8593 - DNA, 31 bp, Artificial Sequence
  Single strand DNA oligonucleotide
aaaggatccgaaggtaaggcaggagtgtgag

SEQ ID NO: 8594 - DNA, 28 bp, Artificial Sequence
  Single strand DNA oligonucleotide
aaaggatccacaggccacaacgattctc

SEQ ID NO: 8595 - DNA, 27 bp, Artificial Sequence
  Single strand DNA oligonucleotide
aaagtcgacctgtgcgcgttgtttctc

SEQ ID NO: 8596 - DNA, 31 bp, Artificial Sequence
  Single strand DNA oligonucleotide
aaaggatcctaacacaaacaggttgcactcc

SEQ ID NO: 8597 - DNA, 28 bp, Artificial Sequence
  Single strand DNA oligonucleotide
aaagtcgacgagagcaccttccgattcc

SEQ ID NO: 8598 - DNA, 31 bp, Artificial Sequence
  Single strand DNA oligonucleotide
aaaggatcctctgctaatcccagtcaaatcg

SEQ ID NO: 8599 - DNA, 28 bp, Artificial Sequence
  Single strand DNA oligonucleotide
aaaggatccgatcgccaattcgtcttcc

SEQ ID NO: 8600 - DNA, 33 bp, Artificial Sequence
  Single strand DNA oligonucleotide
aaaggatccctcaattgtcagtcagtagcatcc

SEQ ID NO: 8601 - DNA, 30 bp, Artificial Sequence
  Single strand DNA oligonucleotide
aaaggatccccgtaggtgtcacgagatttg

SEQ ID NO: 8602 - DNA, 31 bp, Artificial Sequence
  Single strand DNA oligonucleotide
aaaggatccccttccaagcaatcacatcttc

SEQ ID NO: 8603 - DNA, 27 bp, Artificial Sequence
  Single strand DNA oligonucleotide
aaagtcgacctccgatggggaagtctc

SEQ ID NO: 8604 - DNA, 27 bp, Artificial Sequence
  Single strand DNA oligonucleotide
aaaggatccacgagaaactccggcgag

SEQ ID NO: 8605 - DNA, 29 bp, Artificial Sequence
  Single strand DNA oligonucleotide
aaaggatcccacacaaggagctgaagtgc

SEQ ID NO: 8606 - DNA, 31 bp, Artificial Sequence
  Single strand DNA oligonucleotide
aaaggatccccaaactaccaaagcgagagac

SEQ ID NO: 8607 - DNA, 32 bp, Artificial Sequence
  Single strand DNA oligonucleotide
aaaggatcccatgctatggttaacgagcaaac

SEQ ID NO: 8608 - DNA, 26 bp, Artificial Sequence
  Single strand DNA oligonucleotide
aaaggatcctccggcagcggtacgat

SEQ ID NO: 8609 - DNA, 31 bp, Artificial Sequence
  Single strand DNA oligonucleotide
aaaggatccgagaccaaaccaagctctctcc

SEQ ID NO: 8610 - DNA, 30 bp, Artificial Sequence
  Single strand DNA oligonucleotide
aaactcgagatcgcccagttctctcttctc

SEQ ID NO: 8611 - DNA, 28 bp, Artificial Sequence
  Single strand DNA oligonucleotide
aaagtcgacataaatgcgtccgcaaatg

SEQ ID NO: 8612 - DNA, 31 bp, Artificial Sequence
  Single strand DNA oligonucleotide
aaagtcgacaaccgaatagcgaaggcataag

SEQ ID NO: 8613 - DNA, 29 bp, Artificial Sequence
  Single strand DNA oligonucleotide
aaaggatccgatcgagggaagggaacaag

SEQ ID NO: 8614 - DNA, 28 bp, Artificial Sequence
  Single strand DNA oligonucleotide
aaagtcgactcatcccctatccgcgtac

SEQ ID NO: 8615 - DNA, 28 bp, Artificial Sequence
  Single strand DNA oligonucleotide
aaaggatccggatacgaggaggggaagg

SEQ ID NO: 8616 - DNA, 31 bp, Artificial Sequence
  Single strand DNA oligonucleotide
aaaggatccggagttgcctccttcaagctac

SEQ ID NO: 8617 - DNA, 27 bp, Artificial Sequence
  Single strand DNA oligonucleotide
aaaggatccactctttcgttgggccag

SEQ ID NO: 8618 - DNA, 29 bp, Artificial Sequence
  Single strand DNA oligonucleotide
aaaggatccagaacaagtcgcagccaaac

SEQ ID NO: 8619 - DNA, 31 bp, Artificial Sequence
  Single strand DNA oligonucleotide
aaaggatccccgactactccgtttctcttcc

SEQ ID NO: 8620 - DNA, 28 bp, Artificial Sequence
  Single strand DNA oligonucleotide
aaaggatccatcacacacgagtcccgtc

SEQ ID NO: 8621 - DNA, 31 bp, Artificial Sequence
  Single strand DNA oligonucleotide
aaaggatcctatttcgatcgtggtgtgagtc

SEQ ID NO: 8622 - DNA, 31 bp, Artificial Sequence
  Single strand DNA oligonucleotide
aaaggatcccaactctgctgcatcttcttcc

SEQ ID NO: 8623 - DNA, 31 bp, Artificial Sequence
  Single strand DNA oligonucleotide
aaaggatccaaacgaaagagacctgcatctg

SEQ ID NO: 8624 - DNA, 29 bp, Artificial Sequence
  Single strand DNA oligonucleotide
aaagtcgacgttccctgtctgcaatttcg

SEQ ID NO: 8625 - DNA, 31 bp, Artificial Sequence
  Single strand DNA oligonucleotide
aaactcgagtgcgtttcttctcctgttcatc

SEQ ID NO: 8626 - DNA, 31 bp, Artificial Sequence
  Single strand DNA oligonucleotide
aaaggatcccaagcccttctcaactcaagtc

SEQ ID NO: 8627 - DNA, 31 bp, Artificial Sequence
  Single strand DNA oligonucleotide
aaaggatcccttcagacttgagtccacccag

SEQ ID NO: 8628 - DNA, 31 bp, Artificial Sequence
  Single strand DNA oligonucleotide
aaaggatccctgccacagagacatcagagag

SEQ ID NO: 8629 - DNA, 30 bp, Artificial Sequence
  Single strand DNA oligonucleotide
aaagtcgacacgtctactcgcatcccaatc

SEQ ID NO: 8630 - DNA, 31 bp, Artificial Sequence
  Single strand DNA oligonucleotide
aaaggatccctccacctcctacaggctacag

SEQ ID NO: 8631 - DNA, 32 bp, Artificial Sequence
  Single strand DNA oligonucleotide
aaaggatccaatacacctcttcttccctcacc

SEQ ID NO: 8632 - DNA, 31 bp, Artificial Sequence
  Single strand DNA oligonucleotide
aaagtcgaccatccactgacttcctctgttc

SEQ ID NO: 8633 - DNA, 31 bp, Artificial Sequence
  Single strand DNA oligonucleotide
aaagtcgacactaatccgactccctagctcc

SEQ ID NO: 8634 - DNA, 30 bp, Artificial Sequence
  Single strand DNA oligonucleotide
aaaggatcccactcccacctgtaggttcac

SEQ ID NO: 8635 - DNA, 31 bp, Artificial Sequence
  Single strand DNA oligonucleotide
aaaggatccaattattcgattcccaagccac

SEQ ID NO: 8636 - DNA, 26 bp, Artificial Sequence
  Single strand DNA oligonucleotide
aaggatccaccgaaatggggaagctg

SEQ ID NO: 8637 - DNA, 28 bp, Artificial Sequence
  Single strand DNA oligonucleotide
aaaggatccagttgctgtggctttgtgc

SEQ ID NO: 8638 - DNA, 28 bp, Artificial Sequence
  Single strand DNA oligonucleotide
aaagtcgacatctccagtccgcacgaag

SEQ ID NO: 8639 - DNA, 32 bp, Artificial Sequence
  Single strand DNA oligonucleotide
aaagtcgacgggattccgtaaatatcccattc

SEQ ID NO: 8640 - DNA, 28 bp, Artificial Sequence
  Single strand DNA oligonucleotide
aaagtcgactcagtaatggcgcaggatg

SEQ ID NO: 8641 - DNA, 31 bp, Artificial Sequence
  Single strand DNA oligonucleotide
aaaggatccgtatttgtccacgtctccttcg

SEQ ID NO: 8642 - DNA, 32 bp, Artificial Sequence
  Single strand DNA oligonucleotide
aaaggatccatttgcagctagcttagctttgg

SEQ ID NO: 8643 - DNA, 27 bp, Artificial Sequence
  Single strand DNA oligonucleotide
aaaggatccacctgtcgttgctctccg

SEQ ID NO: 8644 - DNA, 31 bp, Artificial Sequence
  Single strand DNA oligonucleotide
aaaggatccacttggttcgtcttccactcat

SEQ ID NO: 8645 - DNA, 28 bp, Artificial Sequence
  Single strand DNA oligonucleotide
aaaggatccagagaccagcgaccgtttc

SEQ ID NO: 8646 - DNA, 32 bp, Artificial Sequence
  Single strand DNA oligonucleotide
aaaggatccccgtcctctccagtctctagttc

SEQ ID NO: 8647 - DNA, 29 bp, Artificial Sequence
  Single strand DNA oligonucleotide
aaaggatcccgaggaatcaccacacacac

SEQ ID NO: 8648 - DNA, 31 bp, Artificial Sequence
  Single strand DNA oligonucleotide
aaaggatccattcactttgccttcgctttag

SEQ ID NO: 8649 - DNA, 30 bp, Artificial Sequence
  Single strand DNA oligonucleotide
aaactcgagagtccaccacaattcagaagc

SEQ ID NO: 8650 - DNA, 29 bp, Artificial Sequence
  Single strand DNA oligonucleotide
aaaggatccgctcggcttagacaagcctc

SEQ ID NO: 8651 - DNA, 28 bp, Artificial Sequence
  Single strand DNA oligonucleotide
aaaggatcctctcctgccaaaccctagc

SEQ ID NO: 8652 - DNA, 31 bp, Artificial Sequence
  Single strand DNA oligonucleotide
aaaggatccaccagtccaccactacatcctc

SEQ ID NO: 8653 - DNA, 28 bp, Artificial Sequence
  Single strand DNA oligonucleotide
aaaggatccagtcggataccgaacctcg

SEQ ID NO: 8654 - DNA, 31 bp, Artificial Sequence
  Single strand DNA oligonucleotide
aaactcgagcaccattactgaaatgcagagc

SEQ ID NO: 8655 - DNA, 29 bp, Artificial Sequence
  Single strand DNA oligonucleotide
aaagtcgacgaactctaccccgcagtctc

SEQ ID NO: 8656 - DNA, 31 bp, Artificial Sequence
  Single strand DNA oligonucleotide
aaaggatccgatccaaccaaagaccctatcc

SEQ ID NO: 8657 - DNA, 31 bp, Artificial Sequence
  Single strand DNA oligonucleotide
aaaggatccttgcttccacttctgattcctc

SEQ ID NO: 8658 - DNA, 31 bp, Artificial Sequence
  Single strand DNA oligonucleotide
aaaggatccgggctctccgtaagtttctttg

SEQ ID NO: 8659 - DNA, 31 bp, Artificial Sequence
  Single strand DNA oligonucleotide
aaaggatccctaaaccctagcttgggcactc

SEQ ID NO: 8660 - DNA, 31 bp, Artificial Sequence
  Single strand DNA oligonucleotide
aaagaattcattattcgaaaccatctcgtcg

SEQ ID NO: 8661 - DNA, 31 bp, Artificial Sequence
  Single strand DNA oligonucleotide
aaaggatccgaaagaacgttacatcacgcac

SEQ ID NO: 8662 - DNA, 32 bp, Artificial Sequence
  Single strand DNA oligonucleotide
aaaggatcctaacaggatctccatctccatcc

SEQ ID NO: 8663 - DNA, 31 bp, Artificial Sequence
  Single strand DNA oligonucleotide
aaaggatcccagctctgctctgtttgcttac

SEQ ID NO: 8664 - DNA, 31 bp, Artificial Sequence
  Single strand DNA oligonucleotide
aaaggatcccttcacgcttgagctagctttc

SEQ ID NO: 8665 - DNA, 29 bp, Artificial Sequence
  Single strand DNA oligonucleotide
aaaggatccagatcatggcgtcatcttcc

SEQ ID NO: 8666 - DNA, 31 bp, Artificial Sequence
  Single strand DNA oligonucleotide
aaagtcgactcatgccaacattgaagatacc

SEQ ID NO: 8667 - DNA, 28 bp, Artificial Sequence
  Single strand DNA oligonucleotide
aaaggatcccaactaggcatggacgacc

SEQ ID NO: 8668 - DNA, 31 bp, Artificial Sequence
  Single strand DNA oligonucleotide
aaactcgagatctatcacctgctgctccaag

SEQ ID NO: 8669 - DNA, 30 bp, Artificial Sequence
  Single strand DNA oligonucleotide
aaagaattccaaagaaatagcgccaacaag

SEQ ID NO: 8670 - DNA, 31 bp, Artificial Sequence
  Single strand DNA oligonucleotide
aaaggatccggatacagccatccattggtag

SEQ ID NO: 8671 - DNA, 30 bp, Artificial Sequence
  Single strand DNA oligonucleotide
aaagtcgacagctttctactgccatcctcc

SEQ ID NO: 8672 - DNA, 31 bp, Artificial Sequence
  Single strand DNA oligonucleotide
aaaggatcctcttggtcgtctcacactgttc

SEQ ID NO: 8673 - DNA, 31 bp, Artificial Sequence
  Single strand DNA oligonucleotide
aaaggatcctctcctccgtccatttactcac

SEQ ID NO: 8674 - DNA, 31 bp, Artificial Sequence
  Single strand DNA oligonucleotide
aaaggatccagctccatagcacttgttccag

SEQ ID NO: 8675 - DNA, 30 bp, Artificial Sequence
  Single strand DNA oligonucleotide
aaaggatccaattcatccaccttgtccgtc

SEQ ID NO: 8676 - DNA, 28 bp, Artificial Sequence
  Single strand DNA oligonucleotide
aaaggatccaagcaaagccctcctctcc

SEQ ID NO: 8677 - DNA, 29 bp, Artificial Sequence
  Single strand DNA oligonucleotide
aaagtcgacctagcggaagcaaagcagag

SEQ ID NO: 8678 - DNA, 29 bp, Artificial Sequence
  Single strand DNA oligonucleotide
aaaggatcccttgcttttgcgcaagtttc

SEQ ID NO: 8679 - DNA, 31 bp, Artificial Sequence
  Single strand DNA oligonucleotide
aaaggatccttgctagctcactcctctcctc

SEQ ID NO: 8680 - DNA, 36 bp, Artificial Sequence
  Single strand DNA oligonucleotide
aaaggatccgcaggtagcgcaagaagataaatatac

SEQ ID NO: 8681 - DNA, 30 bp, Artificial Sequence
  Single strand DNA oligonucleotide
aaagtcgaccgatctcgctgaaacaagaag

SEQ ID NO: 8682 - DNA, 28 bp, Artificial Sequence
  Single strand DNA oligonucleotide
aaagtcgactcctttggcttggaaccag

SEQ ID NO: 8683 - DNA, 30 bp, Artificial Sequence
  Single strand DNA oligonucleotide
aaaggatccgccgctacactctcatctgac

SEQ ID NO: 8684 - DNA, 29 bp, Artificial Sequence
  Single strand DNA oligonucleotide
aaaggatcccgacttcttcgcaccttctc

SEQ ID NO: 8685 - DNA, 31 bp, Artificial Sequence
  Single strand DNA oligonucleotide
aaaggatccgcgccttcttcagtgttagttc

SEQ ID NO: 8686 - DNA, 30 bp, Artificial Sequence
  Single strand DNA oligonucleotide
aaagtcgaccactgcacatctctccagctc

SEQ ID NO: 8687 - DNA, 31 bp, Artificial Sequence
  Single strand DNA oligonucleotide
aaaggatcctctgcagtctactcccaattcc

SEQ ID NO: 8688 - DNA, 29 bp, Artificial Sequence
  Single strand DNA oligonucleotide
aaaggatcccatcgcaagctcctggttac

SEQ ID NO: 8689 - DNA, 32 bp, Artificial Sequence
  Single strand DNA oligonucleotide
aaaggatccggagctagcgaggatcacatatc

SEQ ID NO: 8690 - DNA, 31 bp, Artificial Sequence
  Single strand DNA oligonucleotide
aaagtcgactccttgatctgaaaggtggaag

SEQ ID NO: 8691 - DNA, 30 bp, Artificial Sequence
  Single strand DNA oligonucleotide
aaagtcgacctgaagctgacgcatagaagg

SEQ ID NO: 8692 - DNA, 30 bp, Artificial Sequence
  Single strand DNA oligonucleotide
aaaggatccctcttgcttgcttcacacgag

SEQ ID NO: 8693 - DNA, 31 bp, Artificial Sequence
  Single strand DNA oligonucleotide
aaagtcgacgccacggttatttatctccctc

SEQ ID NO: 8694 - DNA, 30 bp, Artificial Sequence
  Single strand DNA oligonucleotide
aaagtcgacttcctctcccgactactttgc

SEQ ID NO: 8695 - DNA, 28 bp, Artificial Sequence
  Single strand DNA oligonucleotide
aaaggatccaactcagactgcccaccag

SEQ ID NO: 8696 - DNA, 31 bp, Artificial Sequence
  Single strand DNA oligonucleotide
aaaggatcctgcctattgtcttcttccaagc

SEQ ID NO: 8697 - DNA, 28 bp, Artificial Sequence
  Single strand DNA oligonucleotide
aaaggatccaattccagtccgttcctcg

SEQ ID NO: 8698 - DNA, 32 bp, Artificial Sequence
  Single strand DNA oligonucleotide
aaactcgagtgattgctagattgatccgtagg

SEQ ID NO: 8699 - DNA, 31 bp, Artificial Sequence
  Single strand DNA oligonucleotide
aaagtcgactgcttctacagcgctcctactc

SEQ ID NO: 8700 - DNA, 31 bp, Artificial Sequence
  Single strand DNA oligonucleotide
aaaggatccgatcacactgatcacaagcctc

SEQ ID NO: 8701 - DNA, 29 bp, Artificial Sequence
  Single strand DNA oligonucleotide
aaaggatcccaaaccctaacggagccaac

SEQ ID NO: 8702 - DNA, 27 bp, Artificial Sequence
  Single strand DNA oligonucleotide
aaagtcgacagctcgctcctcgtctcc

SEQ ID NO: 8703 - DNA, 31 bp, Artificial Sequence
  Single strand DNA oligonucleotide
aaaggatccagttcaacgtctgatgcgtttc

SEQ ID NO: 8704 - DNA, 27 bp, Artificial Sequence
  Single strand DNA oligonucleotide
aaaggatcccacctgtgagaggcaccg

SEQ ID NO: 8705 - DNA, 31 bp, Artificial Sequence
  Single strand DNA oligonucleotide
aaaggatcccttcacccgtccgttcttaaac

SEQ ID NO: 8706 - DNA, 31 bp, Artificial Sequence
  Single strand DNA oligonucleotide
aaaggatccctccaagaccatttcaacatcc

SEQ ID NO: 8707 - DNA, 32 bp, Artificial Sequence
  Single strand DNA oligonucleotide
aaaggatccctttcccaacgttattaacccac

SEQ ID NO: 8708 - DNA, 27 bp, Artificial Sequence
  Single strand DNA oligonucleotide
aaaggatccagatcgccggattcgtgc

SEQ ID NO: 8709 - DNA, 31 bp, Artificial Sequence
  Single strand DNA oligonucleotide
aaactcgagggtcgcttctttcctacgactc

SEQ ID NO: 8710 - DNA, 29 bp, Artificial Sequence
  Single strand DNA oligonucleotide
aaagatatctaccggcgtataaaagcacc

SEQ ID NO: 8711 - DNA, 31 bp, Artificial Sequence
  Single strand DNA oligonucleotide
aaagtcgacaccaaataggcccataaagctg

SEQ ID NO: 8712 - DNA, 31 bp, Artificial Sequence
  Single strand DNA oligonucleotide
aaagtcgactaacaccaccctcgtttctctc

SEQ ID NO: 8713 - DNA, 36 bp, Artificial Sequence
  Single strand DNA oligonucleotide
aaagtcgacacagaggagatcaatcaatgtattacc

SEQ ID NO: 8714 - DNA, 30 bp, Artificial Sequence
  Single strand DNA oligonucleotide
aaaggatccacagcagcagtaacaatggct

SEQ ID NO: 8715 - DNA, 31 bp, Artificial Sequence
  Single strand DNA oligonucleotide
aaaggatccacaccgttctccattccatatc

SEQ ID NO: 8716 - DNA, 31 bp, Artificial Sequence
  Single strand DNA oligonucleotide
aaaggatcctggttgatctgtagagcgagac

SEQ ID NO: 8717 - DNA, 29 bp, Artificial Sequence
  Single strand DNA oligonucleotide
aaaggatccaaaagctcacgagttgcgtc

SEQ ID NO: 8718 - DNA, 34 bp, Artificial Sequence
  Single strand DNA oligonucleotide
aaaggatcccgaggctacagctagtacatctgac

SEQ ID NO: 8719 - DNA, 28 bp, Artificial Sequence
  Single strand DNA oligonucleotide
aaaggatcccgtcctcctcctcatcagc

SEQ ID NO: 8720 - DNA, 28 bp, Artificial Sequence
  Single strand DNA oligonucleotide
aaaggatccgaagtggcgaactgaatcg

SEQ ID NO: 8721 - DNA, 26 bp, Artificial Sequence
  Single strand DNA oligonucleotide
aaaggatccacgcgatgtccgttgtg

SEQ ID NO: 8722 - DNA, 31 bp, Artificial Sequence
  Single strand DNA oligonucleotide
aaaggatcccaaagcttcctttcacctcaag

SEQ ID NO: 8723 - DNA, 31 bp, Artificial Sequence
  Single strand DNA oligonucleotide
aaaggatccctatcctctccaccttctcagc

SEQ ID NO: 8724 - DNA, 31 bp, Artificial Sequence
  Single strand DNA oligonucleotide
aaaggatccaggtgttcttggaaggttctcc

SEQ ID NO: 8725 - DNA, 28 bp, Artificial Sequence
  Single strand DNA oligonucleotide
aaagtcgacattcgctaccgacctgacc

SEQ ID NO: 8726 - DNA, 30 bp, Artificial Sequence
  Single strand DNA oligonucleotide
aaaggatccactctacctggcaactgcgac

SEQ ID NO: 8727 - DNA, 31 bp, Artificial Sequence
  Single strand DNA oligonucleotide
aaaggatccggcctactgctctaggtcttcc

SEQ ID NO: 8728 - DNA, 30 bp, Artificial Sequence
  Single strand DNA oligonucleotide
aaaggatcctgagggccaaagtttagcttg

SEQ ID NO: 8729 - DNA, 29 bp, Artificial Sequence
  Single strand DNA oligonucleotide
aaaggatccactgcaacgggtctgtcttg

SEQ ID NO: 8730 - DNA, 32 bp, Artificial Sequence
  Single strand DNA oligonucleotide
aaaggatcctatctcctcgtgtcttgtcttcg

SEQ ID NO: 8731 - DNA, 31 bp, Artificial Sequence
  Single strand DNA oligonucleotide
aaaggatcccataggtgcaaggataggcaac

SEQ ID NO: 8732 - DNA, 35 bp, Artificial Sequence
  Single strand DNA oligonucleotide
aaaggatccacattgacgtaattcatagtgggaag

SEQ ID NO: 8733 - DNA, 30 bp, Artificial Sequence
  Single strand DNA oligonucleotide
aaaggatccgacgctctctcatcaccaatc

SEQ ID NO: 8734 - DNA, 26 bp, Artificial Sequence
  Single strand DNA oligonucleotide
aaagatatctctcgatggccgacgac

SEQ ID NO: 8735 - DNA, 30 bp, Artificial Sequence
  Single strand DNA oligonucleotide
aaaggatccagcaagtagcagcttctgtcg

SEQ ID NO: 8736 - DNA, 31 bp, Artificial Sequence
  Single strand DNA oligonucleotide
aaaggtaccgcatccacaggatacaaacaag

SEQ ID NO: 8737 - DNA, 36 bp, Artificial Sequence
  Single strand DNA oligonucleotide
aaaggtaccctaggaacaatctatggctatgagcac

SEQ ID NO: 8738 - DNA, 31 bp, Artificial Sequence
  Single strand DNA oligonucleotide
aaagaattcaacagagcatgcaatctgacac

SEQ ID NO: 8739 - DNA, 31 bp, Artificial Sequence
  Single strand DNA oligonucleotide
aaaggtaccaatgcaccactgaacaagtctg

SEQ ID NO: 8740 - DNA, 34 bp, Artificial Sequence
  Single strand DNA oligonucleotide
aaaaggcctctaagcaacgaagtcactgcctaac

SEQ ID NO: 8741 - DNA, 33 bp, Artificial Sequence
  Single strand DNA oligonucleotide
aaaggtaccctaagcaacacgaataacgaaacg

SEQ ID NO: 8742 - DNA, 35 bp, Artificial Sequence
  Single strand DNA oligonucleotide
aaaggtaccctacaggcaggtgcttacatacaaag

SEQ ID NO: 8743 - DNA, 33 bp, Artificial Sequence
  Single strand DNA oligonucleotide
tttgaattcttatgccactgctagctgatgttg

SEQ ID NO: 8744 - DNA, 35 bp, Artificial Sequence
  Single strand DNA oligonucleotide
tttggtaccatgccgcgtagaagtacagtctgagc

SEQ ID NO: 8745 - DNA, 35 bp, Artificial Sequence
  Single strand DNA oligonucleotide
tttggtaccttattgacactgtagagcaggatcac

SEQ ID NO: 8746 - DNA, 31 bp, Artificial Sequence
  Single strand DNA oligonucleotide
aaaggtacccaagagctacagcagcaacatc

SEQ ID NO: 8747 - DNA, 34 bp, Artificial Sequence
  Single strand DNA oligonucleotide
aaagaattcctatgctgcatcatcttcttgactg

SEQ ID NO: 8748 - DNA, 32 bp, Artificial Sequence
  Single strand DNA oligonucleotide
tttgaattcttactactccttgttccgggtgg

SEQ ID NO: 8749 - DNA, 31 bp, Artificial Sequence
  Single strand DNA oligonucleotide
aaagaattcattctggctaacaagtgccaag

SEQ ID NO: 8750 - DNA, 34 bp, Artificial Sequence
  Single strand DNA oligonucleotide
tttgaattcttactttaaaaggtgcggaaaattc

SEQ ID NO: 8751 - DNA, 32 bp, Artificial Sequence
  Single strand DNA oligonucleotide
aaaggtaccagagtaatcagtccctgcagatg

SEQ ID NO: 8752 - DNA, 33 bp, Artificial Sequence
  Single strand DNA oligonucleotide
aaaggtaccccgtgtcctcttctttatcaacac

SEQ ID NO: 8753 - DNA, 31 bp, Artificial Sequence
  Single strand DNA oligonucleotide
aaaggtacctctgaatagcatcacggcatag

SEQ ID NO: 8754 - DNA, 34 bp, Artificial Sequence
  Single strand DNA oligonucleotide
aaaggtaccctataacccttgtccgtcaccatac

SEQ ID NO: 8755 - DNA, 31 bp, Artificial Sequence
  Single strand DNA oligonucleotide
aaaggtacccagtgcgctataaactcggttg

SEQ ID NO: 8756 - DNA, 30 bp, Artificial Sequence
  Single strand DNA oligonucleotide
aaaggatccctacatcgtcgatcgcctttc

SEQ ID NO: 8757 - DNA, 35 bp, Artificial Sequence
  Single strand DNA oligonucleotide
tttgaattcctacatctattccaccggcacaggca

SEQ ID NO: 8758 - DNA, 32 bp, Artificial Sequence
  Single strand DNA oligonucleotide
tttggtaccgcttgtacgttattacgggttcg

SEQ ID NO: 8759 - DNA, 32 bp, Artificial Sequence
  Single strand DNA oligonucleotide
aaaaggcctctgaaataaattgtgggtgaagc

SEQ ID NO: 8760 - DNA, 34 bp, Artificial Sequence
  Single strand DNA oligonucleotide
tttggtaccttatcgaataaaatcccatcaagtc

SEQ ID NO: 8761 - DNA, 31 bp, Artificial Sequence
  Single strand DNA oligonucleotide
aaaggatccgagtcaccgtataacagccacc

SEQ ID NO: 8762 - DNA, 33 bp, Artificial Sequence
  Single strand DNA oligonucleotide
tttgagctcttactaattgaggtaacgcctgca

SEQ ID NO: 8763 - DNA, 34 bp, Artificial Sequence
  Single strand DNA oligonucleotide
aaaaggcctctattaacaagaaccacaatgccac

SEQ ID NO: 8764 - DNA, 29 bp, Artificial Sequence
  Single strand DNA oligonucleotide
aaaggtaccttgtttacatgctggcttgg

SEQ ID NO: 8765 - DNA, 31 bp, Artificial Sequence
  Single strand DNA oligonucleotide
aaaggtacccgactacactggagcaggaaag

SEQ ID NO: 8766 - DNA, 35 bp, Artificial Sequence
  Single strand DNA oligonucleotide
tttgaattcagcctaagcctacccctttattagcc

SEQ ID NO: 8767 - DNA, 31 bp, Artificial Sequence
  Single strand DNA oligonucleotide
aaaggtacccgcatcatctctcctggattac

SEQ ID NO: 8768 - DNA, 31 bp, Artificial Sequence
  Single strand DNA oligonucleotide
aaaggtacccaggaactgtggcttccattag

SEQ ID NO: 8769 - DNA, 31 bp, Artificial Sequence
  Single strand DNA oligonucleotide
tttgaattcttactacctgccttcagtgctg

SEQ ID NO: 8770 - DNA, 31 bp, Artificial Sequence
  Single strand DNA oligonucleotide
aaagaattcttatgcactcataatcgcaacc

SEQ ID NO: 8771 - DNA, 34 bp, Artificial Sequence
  Single strand DNA oligonucleotide
aaaaggcctctatctggatatcctttccggtagc

SEQ ID NO: 8772 - DNA, 30 bp, Artificial Sequence
  Single strand DNA oligonucleotide
aaaggtaccttacacacgacgatgatgagc

SEQ ID NO: 8773 - DNA, 31 bp, Artificial Sequence
  Single strand DNA oligonucleotide
aaagaattcagggacacccaatcaaacatac

SEQ ID NO: 8774 - DNA, 31 bp, Artificial Sequence
  Single strand DNA oligonucleotide
aaaggtaccatagcgagcacggtaagatttg

SEQ ID NO: 8775 - DNA, 31 bp, Artificial Sequence
  Single strand DNA oligonucleotide
aaaggtaccgacatcacgatcacgacagttc

SEQ ID NO: 8776 - DNA, 31 bp, Artificial Sequence
  Single strand DNA oligonucleotide
aaagaattccagaacgaacaagcctgaactc

SEQ ID NO: 8777 - DNA, 31 bp, Artificial Sequence
  Single strand DNA oligonucleotide
aaaggtaccgccctcctttagctggaaatac

SEQ ID NO: 8778 - DNA, 31 bp, Artificial Sequence
  Single strand DNA oligonucleotide
aaaggatccagaacagatgctcagcggatac

SEQ ID NO: 8779 - DNA, 31 bp, Artificial Sequence
  Single strand DNA oligonucleotide
aaactcgagtcacagctagggtcctaaccac

SEQ ID NO: 8780 - DNA, 31 bp, Artificial Sequence
  Single strand DNA oligonucleotide
aaaggtaccgtagagcttggaacagtgcatc

SEQ ID NO: 8781 - DNA, 31 bp, Artificial Sequence
  Single strand DNA oligonucleotide
aaagaattccttctgttctcctccacacgac

SEQ ID NO: 8782 - DNA, 31 bp, Artificial Sequence
  Single strand DNA oligonucleotide
aaaaggcctggatcaaatgttgccttaccag

SEQ ID NO: 8783 - DNA, 31 bp, Artificial Sequence
  Single strand DNA oligonucleotide
aaaggtacctgggaattcagacaagttcacc

SEQ ID NO: 8784 - DNA, 31 bp, Artificial Sequence
  Single strand DNA oligonucleotide
aaagaattccagttagccgagctcactcatc

SEQ ID NO: 8785 - DNA, 31 bp, Artificial Sequence
  Single strand DNA oligonucleotide
aaaggtaccacaggctataagcttggctcag

SEQ ID NO: 8786 - DNA, 31 bp, Artificial Sequence
  Single strand DNA oligonucleotide
aaaggtacccaaccctgcaaacagtcataag

SEQ ID NO: 8787 - DNA, 35 bp, Artificial Sequence
  Single strand DNA oligonucleotide
aaaggatccatggctaccagatatgttaacagtcg

SEQ ID NO: 8788 - DNA, 34 bp, Artificial Sequence
  Single strand DNA oligonucleotide
aaaggtaccctatacgtggtagcagttcctcctc

SEQ ID NO: 8789 - DNA, 30 bp, Artificial Sequence
  Single strand DNA oligonucleotide
aaagatatcgagacttaggtcacagcgtgc

SEQ ID NO: 8790 - DNA, 36 bp, Artificial Sequence
  Single strand DNA oligonucleotide
aaagaattcctagcagggtaacaaacacaaacactc

SEQ ID NO: 8791 - DNA, 31 bp, Artificial Sequence
  Single strand DNA oligonucleotide
aaaggtaccgacttcggagaatgaagcaaac

SEQ ID NO: 8792 - DNA, 30 bp, Artificial Sequence
  Single strand DNA oligonucleotide
aaaggtaccgtcgccatgaaacattattgg

SEQ ID NO: 8793 - DNA, 35 bp, Artificial Sequence
  Single strand DNA oligonucleotide
aaaggtaccctaatagatgccgtttcggattaaag

SEQ ID NO: 8794 - DNA, 33 bp, Artificial Sequence
  Single strand DNA oligonucleotide
aaaggtacctcaagtttatttggcatgactcac

SEQ ID NO: 8795 - DNA, 32 bp, Artificial Sequence
  Single strand DNA oligonucleotide
ttcggatccttaacctcagcgtctccactcag

SEQ ID NO: 8796 - DNA, 31 bp, Artificial Sequence
  Single strand DNA oligonucleotide
aaaggtacccacatccatcctacaatcctcc

SEQ ID NO: 8797 - DNA, 31 bp, Artificial Sequence
  Single strand DNA oligonucleotide
tttggtaccctatcgctaagccaatgctgag

SEQ ID NO: 8798 - DNA, 31 bp, Artificial Sequence
  Single strand DNA oligonucleotide
aaaggtaccatacatccaacaacccacattg

SEQ ID NO: 8799 - DNA, 32 bp, Artificial Sequence
  Single strand DNA oligonucleotide
aaaggtacctcagaaagagagttcgcgagtag

SEQ ID NO: 8800 - DNA, 36 bp, Artificial Sequence
  Single strand DNA oligonucleotide
tttggtacctcattatgacactcttgcaccctgaag

SEQ ID NO: 8801 - DNA, 31 bp, Artificial Sequence
  Single strand DNA oligonucleotide
aaaggtaccacatcctgcattcaacagtgac

SEQ ID NO: 8802 - DNA, 31 bp, Artificial Sequence
  Single strand DNA oligonucleotide
aaaaggcctacataaaccatgttgcatgctc

SEQ ID NO: 8803 - DNA, 32 bp, Artificial Sequence
  Single strand DNA oligonucleotide
aaagaattcgtggagaaacacagaagcagaac

SEQ ID NO: 8804 - DNA, 26 bp, Artificial Sequence
  Single strand DNA oligonucleotide
tttggatcctcagcagcttccccaca

SEQ ID NO: 8805 - DNA, 31 bp, Artificial Sequence
  Single strand DNA oligonucleotide
aaaggtaccaagccgggaataagctacaaac

SEQ ID NO: 8806 - DNA, 28 bp, Artificial Sequence
  Single strand DNA oligonucleotide
tttggatccagaacctgcagaccgaagc

SEQ ID NO: 8807 - DNA, 31 bp, Artificial Sequence
  Single strand DNA oligonucleotide
aaaggtaccacattcagtagaggcgtcaagg

SEQ ID NO: 8808 - DNA, 32 bp, Artificial Sequence
  Single strand DNA oligonucleotide
aaaggtacccattagtcagctccctcagtttg

SEQ ID NO: 8809 - DNA, 35 bp, Artificial Sequence
  Single strand DNA oligonucleotide
aaaggtaccctacctcttcaggagattcacaaatg

SEQ ID NO: 8810 - DNA, 35 bp, Artificial Sequence
  Single strand DNA oligonucleotide
aaaggtaccctagaatagtgtgttccacttccacc

SEQ ID NO: 8811 - DNA, 31 bp, Artificial Sequence
  Single strand DNA oligonucleotide
aaaggtaccaccctcgtaccactcatcaaac

SEQ ID NO: 8812 - DNA, 31 bp, Artificial Sequence
  Single strand DNA oligonucleotide
aaaggtaccagcttggaaatgcttgaaagag

SEQ ID NO: 8813 - DNA, 30 bp, Artificial Sequence
  Single strand DNA oligonucleotide
aaaggtaccatttgtcacgacaagccaatg

SEQ ID NO: 8814 - DNA, 34 bp, Artificial Sequence
  Single strand DNA oligonucleotide
aaaggtaccctattgacgaagccataaacagaac

SEQ ID NO: 8815 - DNA, 31 bp, Artificial Sequence
  Single strand DNA oligonucleotide
aaaggtaccatctcaagcaacagaggaaagc

SEQ ID NO: 8816 - DNA, 31 bp, Artificial Sequence
  Single strand DNA oligonucleotide
aaagaattcaacaatttattcgctccctgtg

SEQ ID NO: 8817 - DNA, 31 bp, Artificial Sequence
  Single strand DNA oligonucleotide
aaagaattctgtatcggtgtccagcaaatag

SEQ ID NO: 8818 - DNA, 33 bp, Artificial Sequence
  Single strand DNA oligonucleotide
aaagaattccgatcgctactagctgcttatttg

SEQ ID NO: 8819 - DNA, 31 bp, Artificial Sequence
  Single strand DNA oligonucleotide
aaaggtacctcttcaacttcaacatgcaagc

SEQ ID NO: 8820 - DNA, 31 bp, Artificial Sequence
  Single strand DNA oligonucleotide
aaaggtacccttcaccttcaccttcatcagg

SEQ ID NO: 8821 - DNA, 31 bp, Artificial Sequence
  Single strand DNA oligonucleotide
aaagaattctaaggttcctgactatccgctc

SEQ ID NO: 8822 - DNA, 31 bp, Artificial Sequence
  Single strand DNA oligonucleotide
aaaggtaccgcagaagataagaatccgttgc

SEQ ID NO: 8823 - DNA, 33 bp, Artificial Sequence
  Single strand DNA oligonucleotide
aaaggtacccacccaatccttatttattcttcg

SEQ ID NO: 8824 - DNA, 31 bp, Artificial Sequence
  Single strand DNA oligonucleotide
aaaggatccgtatcaccgttgttgcagtagc

SEQ ID NO: 8825 - DNA, 32 bp, Artificial Sequence
  Single strand DNA oligonucleotide
aaagaattccagaacctactagaccatggagg

SEQ ID NO: 8826 - DNA, 31 bp, Artificial Sequence
  Single strand DNA oligonucleotide
aaaggtaccatcagtagaggtcaccaccgac

SEQ ID NO: 8827 - DNA, 31 bp, Artificial Sequence
  Single strand DNA oligonucleotide
aaaggtacccaacacacagtctcgagcaaac

SEQ ID NO: 8828 - DNA, 31 bp, Artificial Sequence
  Single strand DNA oligonucleotide
tttggtaccttagggtcagttgctggagttg

SEQ ID NO: 8829 - DNA, 31 bp, Artificial Sequence
  Single strand DNA oligonucleotide
tttggtacccacccatcgatgatttatttgc

SEQ ID NO: 8830 - DNA, 34 bp, Artificial Sequence
  Single strand DNA oligonucleotide
tttgaattctcaacatcaacggaaaagcatgttc

SEQ ID NO: 8831 - DNA, 29 bp, Artificial Sequence
  Single strand DNA oligonucleotide
ttaggatccttccataggctcgaatgacc

SEQ ID NO: 8832 - DNA, 33 bp, Artificial Sequence
  Single strand DNA oligonucleotide
tttgaattctcaagacgctcaagctgtaccagg

SEQ ID NO: 8833 - DNA, 31 bp, Artificial Sequence
  Single strand DNA oligonucleotide
aaaggtacctcattaacgatgaatctcgcac

SEQ ID NO: 8834 - DNA, 34 bp, Artificial Sequence
  Single strand DNA oligonucleotide
aaaggtacccaactcttctcttccatctgtgttc

SEQ ID NO: 8835 - DNA, 31 bp, Artificial Sequence
  Single strand DNA oligonucleotide
tttggtacctgagcgttcctctgttatgatg

SEQ ID NO: 8836 - DNA, 31 bp, Artificial Sequence
  Single strand DNA oligonucleotide
aaaggtaccacagcagccagcacaaattact

SEQ ID NO: 8837 - DNA, 30 bp, Artificial Sequence
  Single strand DNA oligonucleotide
aaaggtaccagagtttattgcgcccagttc

SEQ ID NO: 8838 - DNA, 32 bp, Artificial Sequence
  Single strand DNA oligonucleotide
aaaggtaccctttccaaatgcatcgaatttac

SEQ ID NO: 8839 - DNA, 31 bp, Artificial Sequence
  Single strand DNA oligonucleotide
aaaggtaccgtgatccaatgtcaagcatcag

SEQ ID NO: 8840 - DNA, 31 bp, Artificial Sequence
  Single strand DNA oligonucleotide
aaaggtaccgttcatcaatcaccatcagcac

SEQ ID NO: 8841 - DNA, 32 bp, Artificial Sequence
  Single strand DNA oligonucleotide
aaagaattctggcacatttctctacacctttc

SEQ ID NO: 8842 - DNA, 31 bp, Artificial Sequence
  Single strand DNA oligonucleotide
aaaggtacccacatcttgacgcaaaccatac

SEQ ID NO: 8843 - DNA, 32 bp, Artificial Sequence
  Single strand DNA oligonucleotide
aaaggtaccctagtgccaacgttgctcaaatc

SEQ ID NO: 8844 - DNA, 31 bp, Artificial Sequence
  Single strand DNA oligonucleotide
aaaggtaccggacgctaacaactgtaccacc

SEQ ID NO: 8845 - DNA, 31 bp, Artificial Sequence
  Single strand DNA oligonucleotide
aaaggtaccaatgaactggcaagggtcatac

SEQ ID NO: 8846 - DNA, 31 bp, Artificial Sequence
  Single strand DNA oligonucleotide
aaagaattctcaactagaggaccaaccaacc

SEQ ID NO: 8847 - DNA, 33 bp, Artificial Sequence
  Single strand DNA oligonucleotide
tttgaattcttattactcctcgtttacggcagc

SEQ ID NO: 8848 - DNA, 32 bp, Artificial Sequence
  Single strand DNA oligonucleotide
aaaggtaccgctttacacaatcttccgaacac

SEQ ID NO: 8849 - DNA, 31 bp, Artificial Sequence
  Single strand DNA oligonucleotide
aaaggtacccttattcgtggcagcattgaac

SEQ ID NO: 8850 - DNA, 33 bp, Artificial Sequence
  Single strand DNA oligonucleotide
aaaaggcctctagttctgattacacgtgggacg

SEQ ID NO: 8851 - DNA, 31 bp, Artificial Sequence
  Single strand DNA oligonucleotide
aaaggtaccttacaaacaccagaggaggacc

SEQ ID NO: 8852 - DNA, 31 bp, Artificial Sequence
  Single strand DNA oligonucleotide
aaaaggcctataccgatctgaagcatgaacc

SEQ ID NO: 8853 - DNA, 34 bp, Artificial Sequence
  Single strand DNA oligonucleotide
aaaggtaccctagcgtcctggagagcatattaag

SEQ ID NO: 8854 - DNA, 35 bp, Artificial Sequence
  Single strand DNA oligonucleotide
aaaggtaccctatacagaggcagtacaagcaatgg

SEQ ID NO: 8855 - DNA, 31 bp, Artificial Sequence
  Single strand DNA oligonucleotide
aaaggtacctgtattcggcttcagaggaaag

SEQ ID NO: 8856 - DNA, 34 bp, Artificial Sequence
  Single strand DNA oligonucleotide
aaaggtaccctaagaagaagcagaatcctcctgg

SEQ ID NO: 8857 - DNA, 35 bp, Artificial Sequence
  Single strand DNA oligonucleotide
tttggtacctcaccatcaatcattcttctgctctc

SEQ ID NO: 8858 - DNA, 31 bp, Artificial Sequence
  Single strand DNA oligonucleotide
aaaaggcctgagagagagcatcaaatcgtcc

SEQ ID NO: 8859 - DNA, 28 bp, Artificial Sequence
  Single strand DNA oligonucleotide
tttggtacctcaagctcaaacagccgtc

SEQ ID NO: 8860 - DNA, 31 bp, Artificial Sequence
  Single strand DNA oligonucleotide
aaagaattcaatggattattcgtcccattcc

SEQ ID NO: 8861 - DNA, 30 bp, Artificial Sequence
  Single strand DNA oligonucleotide
tttgagctcttatcagttcagcctccatgc

SEQ ID NO: 8862 - DNA, 31 bp, Artificial Sequence
  Single strand DNA oligonucleotide
aaaggtacctgggaggaataattcgggtatc

SEQ ID NO: 8863 - DNA, 31 bp, Artificial Sequence
  Single strand DNA oligonucleotide
aaaggatccgtggcatccatcacagaatatg

SEQ ID NO: 8864 - DNA, 31 bp, Artificial Sequence
  Single strand DNA oligonucleotide
aaaggtaccctgctatttcatgacctgatcg

SEQ ID NO: 8865 - DNA, 30 bp, Artificial Sequence
  Single strand DNA oligonucleotide
aaaggtaccagacgcagctttcctcgtatg

SEQ ID NO: 8866 - DNA, 31 bp, Artificial Sequence
  Single strand DNA oligonucleotide
aaaggtaccgctcccttatgatgtgatgatg

SEQ ID NO: 8867 - DNA, 36 bp, Artificial Sequence
  Single strand DNA oligonucleotide
tttggtacctcatgaatacgaacatgcatcatgtag

SEQ ID NO: 8868 - DNA, 31 bp, Artificial Sequence
  Single strand DNA oligonucleotide
aaaggtacccggtgtagtcgtagtgttcctg

SEQ ID NO: 8869 - DNA, 31 bp, Artificial Sequence
  Single strand DNA oligonucleotide
aaaggatccccagctgtgacaaacaagtgac

SEQ ID NO: 8870 - DNA, 31 bp, Artificial Sequence
  Single strand DNA oligonucleotide
aaaggtaccttgccaagacagatcatagcag

SEQ ID NO: 8871 - DNA, 30 bp, Artificial Sequence
  Single strand DNA oligonucleotide
aaaggtacccttgcatagcatagggacgac

SEQ ID NO: 8872 - DNA, 31 bp, Artificial Sequence
  Single strand DNA oligonucleotide
aaagaattccaggatcaaccctgttccatac

SEQ ID NO: 8873 - DNA, 31 bp, Artificial Sequence
  Single strand DNA oligonucleotide
aaaggatcctccgaacgttccagctatttac

SEQ ID NO: 8874 - DNA, 34 bp, Artificial Sequence
  Single strand DNA oligonucleotide
aaagaattcctagcgatcttgaattgatagcctg

SEQ ID NO: 8875 - DNA, 32 bp, Artificial Sequence
  Single strand DNA oligonucleotide
aaagaattcgcagctgtgctgtttataattgg

SEQ ID NO: 8876 - DNA, 34 bp, Artificial Sequence
  Single strand DNA oligonucleotide
aaaggtaccctaaactcctgaatcacactggacc

SEQ ID NO: 8877 - DNA, 31 bp, Artificial Sequence
  Single strand DNA oligonucleotide
aaaggtaccctcagcaaattccatcagtgtg

SEQ ID NO: 8878 - DNA, 34 bp, Artificial Sequence
  Single strand DNA oligonucleotide
aaaggatccctagttaattaagcgaccaccgtcc

SEQ ID NO: 8879 - DNA, 36 bp, Artificial Sequence
  Single strand DNA oligonucleotide
aaaggtaccctagagcttagacctccacttcaattc

SEQ ID NO: 8880 - DNA, 31 bp, Artificial Sequence
  Single strand DNA oligonucleotide
aaaggtaccgtgcgactccagaagctaattc

SEQ ID NO: 8881 - DNA, 31 bp, Artificial Sequence
  Single strand DNA oligonucleotide
aaaggtacccataaatgattggctcatttgg

SEQ ID NO: 8882 - DNA, 31 bp, Artificial Sequence
  Single strand DNA oligonucleotide
aaaaggcctcaattataaagacaccgccagg

SEQ ID NO: 8883 - DNA, 33 bp, Artificial Sequence
  Single strand DNA oligonucleotide
aaagaattcctagggcctagagcttattgatcg

SEQ ID NO: 8884 - DNA, 32 bp, Artificial Sequence
  Single strand DNA oligonucleotide
aaaggtaccttaatgttgtcaccaaccaatcc

SEQ ID NO: 8885 - DNA, 31 bp, Artificial Sequence
  Single strand DNA oligonucleotide
aaaaggccttgtacagttcccaagcttcctc

SEQ ID NO: 8886 - DNA, 31 bp, Artificial Sequence
  Single strand DNA oligonucleotide
aaaaggcctttccaatgacatccagaggaac

SEQ ID NO: 8887 - DNA, 34 bp, Artificial Sequence
  Single strand DNA oligonucleotide
aaagaattcctagtccttgctttgatttgattcg

SEQ ID NO: 8888 - DNA, 32 bp, Artificial Sequence
  Single strand DNA oligonucleotide
aaaggtaccgcaacttattgtcctctcattgc

SEQ ID NO: 8889 - DNA, 31 bp, Artificial Sequence
  Single strand DNA oligonucleotide
aaagaattcaccatcgacctacctttgtgtc

SEQ ID NO: 8890 - DNA, 31 bp, Artificial Sequence
  Single strand DNA oligonucleotide
aaaaggcctcccaagcctttatttgttgagg

SEQ ID NO: 8891 - DNA, 31 bp, Artificial Sequence
  Single strand DNA oligonucleotide
aaagagctcacacggtcacagggaagatatg

SEQ ID NO: 8892 - DNA, 31 bp, Artificial Sequence
  Single strand DNA oligonucleotide
aaaggtacctatcacgacagcatctcagtcc

SEQ ID NO: 8893 - DNA, 31 bp, Artificial Sequence
  Single strand DNA oligonucleotide
aaaggtaccgcctaaagaagtccgcaaattc

SEQ ID NO: 8894 - DNA, 33 bp, Artificial Sequence
  Single strand DNA oligonucleotide
aaagagctcctaatagcagcaacagcaaacagg

SEQ ID NO: 8895 - DNA, 31 bp, Artificial Sequence
  Single strand DNA oligonucleotide
aaaggtaccatgtccatcacattacagcagc

SEQ ID NO: 8896 - DNA, 36 bp, Artificial Sequence
  Single strand DNA oligonucleotide
aaaggtacctcaccacagtcactgtcgacagatatc

SEQ ID NO: 8897 - DNA, 31 bp, Artificial Sequence
  Single strand DNA oligonucleotide
aaaggtaccacatatacggcgacaaggagag

SEQ ID NO: 8898 - DNA, 31 bp, Artificial Sequence
  Single strand DNA oligonucleotide
aaaggtaccaccgagacaagagcaactgaac

SEQ ID NO: 8899 - DNA, 31 bp, Artificial Sequence
  Single strand DNA oligonucleotide
aaaggtaccttggcactactttcatttcagc

SEQ ID NO: 8900 - DNA, 29 bp, Artificial Sequence
  Single strand DNA oligonucleotide
tttctcgagccgtttccaaccatttgagg

SEQ ID NO: 8901 - DNA, 31 bp, Artificial Sequence
  Single strand DNA oligonucleotide
aaagaattcgattgactgcaaatgcacaaag

SEQ ID NO: 8902 - DNA, 32 bp, Artificial Sequence
  Single strand DNA oligonucleotide
aaagaattctcttctaatcttcgtctccgatg

SEQ ID NO: 8903 - DNA, 32 bp, Artificial Sequence
  Single strand DNA oligonucleotide
aaaaggcctttgcaataatcaagtcccaagac

SEQ ID NO: 8904 - DNA, 31 bp, Artificial Sequence
  Single strand DNA oligonucleotide
aaaggatccaacaagtccatgacaacgtcag

SEQ ID NO: 8905 - DNA, 31 bp, Artificial Sequence
  Single strand DNA oligonucleotide
aaagaattccgagaaccaaccaatattcacc

SEQ ID NO: 8906 - DNA, 31 bp, Artificial Sequence
  Single strand DNA oligonucleotide
aaaggtaccacaacgttaattgcgcttgttt

SEQ ID NO: 8907 - DNA, 32 bp, Artificial Sequence
  Single strand DNA oligonucleotide
aaaggtaccgtgtgagctaataggtggattcg

SEQ ID NO: 8908 - DNA, 31 bp, Artificial Sequence
  Single strand DNA oligonucleotide
aaaggtacctgcacaattaaccagagcagag

SEQ ID NO: 8909 - DNA, 31 bp, Artificial Sequence
  Single strand DNA oligonucleotide
aaaggtaccgagtatgcttcacctcaccacc

SEQ ID NO: 8910 - DNA, 31 bp, Artificial Sequence
  Single strand DNA oligonucleotide
aaaggtaccgaacacgagacgacaagttcag

SEQ ID NO: 8911 - DNA, 31 bp, Artificial Sequence
  Single strand DNA oligonucleotide
aaaggtacctattagtggtggtggactggtg

SEQ ID NO: 8912 - DNA, 31 bp, Artificial Sequence
  Single strand DNA oligonucleotide
aaaggtacccacattagcatggctgatctcc

SEQ ID NO: 8913 - DNA, 30 bp, Artificial Sequence
  Single strand DNA oligonucleotide
tttggtacccgttcttcatcagccactgtg

SEQ ID NO: 8914 - DNA, 31 bp, Artificial Sequence
  Single strand DNA oligonucleotide
aaaggtaccagatcgacaatgagcaacaatg

SEQ ID NO: 8915 - DNA, 31 bp, Artificial Sequence
  Single strand DNA oligonucleotide
aaaggtacccatcaaattcctggaaaccaac

SEQ ID NO: 8916 - DNA, 34 bp, Artificial Sequence
  Single strand DNA oligonucleotide
aaaggtaccttagaagaaatggaactgctctacg

SEQ ID NO: 8917 - DNA, 32 bp, Artificial Sequence
  Single strand DNA oligonucleotide
aaagaattcctacatgctaggttgccaaggag

SEQ ID NO: 8918 - DNA, 33 bp, Artificial Sequence
  Single strand DNA oligonucleotide
aaaggtaccttgggtgtactgttttgaagtgac

SEQ ID NO: 8919 - DNA, 31 bp, Artificial Sequence
  Single strand DNA oligonucleotide
aaaggtaccctctctttccacagtagggacg

SEQ ID NO: 8920 - DNA, 33 bp, Artificial Sequence
  Single strand DNA oligonucleotide
aaaggtaccctattggtctgaaatcgagacagg

SEQ ID NO: 8921 - DNA, 31 bp, Artificial Sequence
  Single strand DNA oligonucleotide
aaaggtacccatctgaactcatacgcagcag

SEQ ID NO: 8922 - DNA, 33 bp, Artificial Sequence
  Single strand DNA oligonucleotide
aaaggtaccgactactgggccgaattaaatacc

SEQ ID NO: 8923 - DNA, 31 bp, Artificial Sequence
  Single strand DNA oligonucleotide
aaaggtaccacaggtttgtttacggttcgtc

SEQ ID NO: 8924 - DNA, 31 bp, Artificial Sequence
  Single strand DNA oligonucleotide
aaaggtaccttgggcaatttggatatctctg

SEQ ID NO: 8925 - DNA, 31 bp, Artificial Sequence
  Single strand DNA oligonucleotide
aaaggtaccctagacttgatcgagacggcag

SEQ ID NO: 8926 - DNA, 33 bp, Artificial Sequence
  Single strand DNA oligonucleotide
tttgaattcttacaacagtctccttcagccatg

SEQ ID NO: 8927 - DNA, 31 bp, Artificial Sequence
  Single strand DNA oligonucleotide
aaaggtaccctgaacaatggtacagcaggtc

SEQ ID NO: 8928 - DNA, 31 bp, Artificial Sequence
  Single strand DNA oligonucleotide
aaagaattctggctagcagcaaggtagagag

SEQ ID NO: 8929 - DNA, 28 bp, Artificial Sequence
  Single strand DNA oligonucleotide
aaaggatccaggaagatgcaggccaaga

SEQ ID NO: 8930 - DNA, 30 bp, Artificial Sequence
  Single strand DNA oligonucleotide
aaaggatccaacacactcttcgacacgctc

SEQ ID NO: 8931 - DNA, 27 bp, Artificial Sequence
  Single strand DNA oligonucleotide
aaaggatcctctgatctgcccaccagg

SEQ ID NO: 8932 - DNA, 32 bp, Artificial Sequence
  Single strand DNA oligonucleotide
aaaggatccaagttactggtggtggtggtagc

SEQ ID NO: 8933 - DNA, 31 bp, Artificial Sequence
  Single strand DNA oligonucleotide
aaagtcgacattggaattgcttctctcctcc

SEQ ID NO: 8934 - DNA, 30 bp, Artificial Sequence
  Single strand DNA oligonucleotide
aaagtcgaccgtaggcagaggagaaacagg

SEQ ID NO: 8935 - DNA, 31 bp, Artificial Sequence
  Single strand DNA oligonucleotide
aaaaggcctactagacaaccaccaccgactg

SEQ ID NO: 8936 - DNA, 31 bp, Artificial Sequence
  Single strand DNA oligonucleotide
aaagaattcaccctgctccgagtttagtttc

SEQ ID NO: 8937 - DNA, 30 bp, Artificial Sequence
  Single strand DNA oligonucleotide
aaaggatcctagtctccctccacaagcgtc

SEQ ID NO: 8938 - DNA, 31 bp, Artificial Sequence
  Single strand DNA oligonucleotide
aaaggatccacacaaacacacctcctgattg

SEQ ID NO: 8939 - DNA, 31 bp, Artificial Sequence
  Single strand DNA oligonucleotide
aaaggatcccgcctagctcgagttgtatagc

SEQ ID NO: 8940 - DNA, 31 bp, Artificial Sequence
  Single strand DNA oligonucleotide
aaaggatcccacggcacgcagatacatatag

SEQ ID NO: 8941 - DNA, 31 bp, Artificial Sequence
  Single strand DNA oligonucleotide
aaagtcgactgcgttcttgtagtagaggtcg

SEQ ID NO: 8942 - DNA, 32 bp, Artificial Sequence
  Single strand DNA oligonucleotide
aaaggatccgcgaagcaagacacagataagag

SEQ ID NO: 8943 - DNA, 27 bp, Artificial Sequence
  Single strand DNA oligonucleotide
aaagtcgacacctgccgcaactgaatc

SEQ ID NO: 8944 - DNA, 28 bp, Artificial Sequence
  Single strand DNA oligonucleotide
aaaggatccaagtcccaccaagctgtcc

SEQ ID NO: 8945 - DNA, 29 bp, Artificial Sequence
  Single strand DNA oligonucleotide
aaaggatccgagtgtgagggcaggctaac

SEQ ID NO: 8946 - DNA, 29 bp, Artificial Sequence
  Single strand DNA oligonucleotide
aaaggatccgattctcgtcggtcgttctg

SEQ ID NO: 8947 - DNA, 27 bp, Artificial Sequence
  Single strand DNA oligonucleotide
aaagtcgacttgtttctcgtcgccgtc

SEQ ID NO: 8948 - DNA, 31 bp, Artificial Sequence
  Single strand DNA oligonucleotide
aaaggatcctaacagcatacacagggcagac

SEQ ID NO: 8949 - DNA, 29 bp, Artificial Sequence
  Single strand DNA oligonucleotide
aaaggatccctgcaacccttcttcccttc

SEQ ID NO: 8950 - DNA, 32 bp, Artificial Sequence
  Single strand DNA oligonucleotide
aaaggatcccggagcagtactaggttggtagg

SEQ ID NO: 8951 - DNA, 31 bp, Artificial Sequence
  Single strand DNA oligonucleotide
aaaggatccggaaggaatcgacacagagttc

SEQ ID NO: 8952 - DNA, 31 bp, Artificial Sequence
  Single strand DNA oligonucleotide
aaaggatccaagctcacctcatccctctttc

SEQ ID NO: 8953 - DNA, 31 bp, Artificial Sequence
  Single strand DNA oligonucleotide
aaaggatccgctcgatatcggagtccagtag

SEQ ID NO: 8954 - DNA, 31 bp, Artificial Sequence
  Single strand DNA oligonucleotide
aaactcgagatctactcctcgtcttggcgtc

SEQ ID NO: 8955 - DNA, 31 bp, Artificial Sequence
  Single strand DNA oligonucleotide
aaagtcgacgaaggcataagccatcagtttc

SEQ ID NO: 8956 - DNA, 29 bp, Artificial Sequence
  Single strand DNA oligonucleotide
aaaggatccggcagtgatcttcttgcgtc

SEQ ID NO: 8957 - DNA, 31 bp, Artificial Sequence
  Single strand DNA oligonucleotide
aaaggatcctactcagcctactccgtcttcc

SEQ ID NO: 8958 - DNA, 31 bp, Artificial Sequence
  Single strand DNA oligonucleotide
aaaggatcctagaaatcctgtcctgtcgctc

SEQ ID NO: 8959 - DNA, 31 bp, Artificial Sequence
  Single strand DNA oligonucleotide
aaaggatccccactctccagtctccactagc

SEQ ID NO: 8960 - DNA, 31 bp, Artificial Sequence
  Single strand DNA oligonucleotide
aaaggatccaatccactctacatgtcccacg

SEQ ID NO: 8961 - DNA, 29 bp, Artificial Sequence
  Single strand DNA oligonucleotide
aaagtcgacctactcgcatcccaatctcc

SEQ ID NO: 8962 - DNA, 31 bp, Artificial Sequence
  Single strand DNA oligonucleotide
aaaggatcccgaagccctactcaacttctcc

SEQ ID NO: 8963 - DNA, 32 bp, Artificial Sequence
  Single strand DNA oligonucleotide
aaagtcgactgttctctttctcctaccgcttc

SEQ ID NO: 8964 - DNA, 31 bp, Artificial Sequence
  Single strand DNA oligonucleotide
aaaggatccggaacaacagaatccagaaacc

SEQ ID NO: 8965 - DNA, 31 bp, Artificial Sequence
  Single strand DNA oligonucleotide
aaaggatcctggtttcctctgcttctcattc

SEQ ID NO: 8966 - DNA, 27 bp, Artificial Sequence
  Single strand DNA oligonucleotide
aaaggatccccaccaatggagagcctc

SEQ ID NO: 8967 - DNA, 28 bp, Artificial Sequence
  Single strand DNA oligonucleotide
aaaggatccaccagcgaccgtttcactc

SEQ ID NO: 8968 - DNA, 27 bp, Artificial Sequence
  Single strand DNA oligonucleotide
aaaggatccctagcagcgcacggagag

SEQ ID NO: 8969 - DNA, 31 bp, Artificial Sequence
  Single strand DNA oligonucleotide
aaaggatccgctttagcctttgtgctgctac

SEQ ID NO: 8970 - DNA, 28 bp, Artificial Sequence
  Single strand DNA oligonucleotide
aaaggatcctacatcctcacaccgccac

SEQ ID NO: 8971 - DNA, 28 bp, Artificial Sequence
  Single strand DNA oligonucleotide
aaaggatccaccagaggcaagccaagac

SEQ ID NO: 8972 - DNA, 31 bp, Artificial Sequence
  Single strand DNA oligonucleotide
aaagtcgacattgctgggtaagttggaacag

SEQ ID NO: 8973 - DNA, 31 bp, Artificial Sequence
  Single strand DNA oligonucleotide
aaaggatccccattggtagtacacagggtcc

SEQ ID NO: 8974 - DNA, 30 bp, Artificial Sequence
  Single strand DNA oligonucleotide
aaagtcgaccttgtcacccgtcttctctcc

SEQ ID NO: 8975 - DNA, 31 bp, Artificial Sequence
  Single strand DNA oligonucleotide
aaaggatccaccacatagtgcccttaactcc

SEQ ID NO: 8976 - DNA, 31 bp, Artificial Sequence
  Single strand DNA oligonucleotide
aaaggatcccatttactcacacggtcacacc

SEQ ID NO: 8977 - DNA, 34 bp, Artificial Sequence
  Single strand DNA oligonucleotide
aaaggatccgctaggagagagagctttgtttagg

SEQ ID NO: 8978 - DNA, 27 bp, Artificial Sequence
  Single strand DNA oligonucleotide
aaaggatccacccaccttccaaggcag

SEQ ID NO: 8979 - DNA, 28 bp, Artificial Sequence
  Single strand DNA oligonucleotide
aaaggatccctccgtcactcacctcgac

SEQ ID NO: 8980 - DNA, 29 bp, Artificial Sequence
  Single strand DNA oligonucleotide
aaaggatcccttttgcgcaagtttcaagc

SEQ ID NO: 8981 - DNA, 31 bp, Artificial Sequence
  Single strand DNA oligonucleotide
aaagtcgacaacaagaaggaatccaatcgag

SEQ ID NO: 8982 - DNA, 30 bp, Artificial Sequence
  Single strand DNA oligonucleotide
aaaggatccagaagcggcaagtagcatttc

SEQ ID NO: 8983 - DNA, 31 bp, Artificial Sequence
  Single strand DNA oligonucleotide
aaaggatccttagttctccacctcctccttg

SEQ ID NO: 8984 - DNA, 31 bp, Artificial Sequence
  Single strand DNA oligonucleotide
aaaggatcctcccaaaccagaattattggac

SEQ ID NO: 8985 - DNA, 31 bp, Artificial Sequence
  Single strand DNA oligonucleotide
aaaggatccggatcacatatctcgtagcgtg

SEQ ID NO: 8986 - DNA, 31 bp, Artificial Sequence
  Single strand DNA oligonucleotide
aaagtcgactcacaatttctctcgtcgtttg

SEQ ID NO: 8987 - DNA, 29 bp, Artificial Sequence
  Single strand DNA oligonucleotide
aaaggatccagtggttgttcgtcctgtcg

SEQ ID NO: 8988 - DNA, 30 bp, Artificial Sequence
  Single strand DNA oligonucleotide
aaagtcgacggtgtggaaccacttctgatg

SEQ ID NO: 8989 - DNA, 29 bp, Artificial Sequence
  Single strand DNA oligonucleotide
aaaggatcccagactgcccaccagctaag

SEQ ID NO: 8990 - DNA, 31 bp, Artificial Sequence
  Single strand DNA oligonucleotide
aaaggatccagggtaggtgccaggtaaactc

SEQ ID NO: 8991 - DNA, 31 bp, Artificial Sequence
  Single strand DNA oligonucleotide
aaaggatcccgcacctagctagctttctttc

SEQ ID NO: 8992 - DNA, 31 bp, Artificial Sequence
  Single strand DNA oligonucleotide
aaactcgagccgtagggattgatgaagagtg

SEQ ID NO: 8993 - DNA, 30 bp, Artificial Sequence
  Single strand DNA oligonucleotide
aaagtcgactactcagttcagttgcgctgc

SEQ ID NO: 8994 - DNA, 31 bp, Artificial Sequence
  Single strand DNA oligonucleotide
aaaggatcctcttaaaccctgcgtaagcctc

SEQ ID NO: 8995 - DNA, 31 bp, Artificial Sequence
  Single strand DNA oligonucleotide
aaaggatcctcaacatccacaaactcagtcg

SEQ ID NO: 8996 - DNA, 30 bp, Artificial Sequence
  Single strand DNA oligonucleotide
aaaggatcctattaacccacgcaatcggac

SEQ ID NO: 8997 - DNA, 27 bp, Artificial Sequence
  Single strand DNA oligonucleotide
aaaggatccagcgggatggactcggac

SEQ ID NO: 8998 - DNA, 26 bp, Artificial Sequence
  Single strand DNA oligonucleotide
aaagatatcccgctctcgtcatcgtc

SEQ ID NO: 8999 - DNA, 31 bp, Artificial Sequence
  Single strand DNA oligonucleotide
aaagtcgacgtgcgctagctttctctcaatc

SEQ ID NO: 9000 - DNA, 31 bp, Artificial Sequence
  Single strand DNA oligonucleotide
aaagtcgaccctcgagctctgcttagatcac

SEQ ID NO: 9001 - DNA, 31 bp, Artificial Sequence
  Single strand DNA oligonucleotide
aaaggatccgcaactgcatgtacttctgcac

SEQ ID NO: 9002 - DNA, 30 bp, Artificial Sequence
  Single strand DNA oligonucleotide
aaaggatccaccggcaattgtagaaaccag

SEQ ID NO: 9003 - DNA, 31 bp, Artificial Sequence
  Single strand DNA oligonucleotide
aaaggatccagtacatctgacagagcccgac

SEQ ID NO: 9004 - DNA, 31 bp, Artificial Sequence
  Single strand DNA oligonucleotide
aaaggatccctcaagataaggagatcgcagc

SEQ ID NO: 9005 - DNA, 31 bp, Artificial Sequence
  Single strand DNA oligonucleotide
aaaggatcctctcagccacacagagaaagag

SEQ ID NO: 9006 - DNA, 31 bp, Artificial Sequence
  Single strand DNA oligonucleotide
aaaggatccccatcgccgttaccttctttag

SEQ ID NO: 9007 - DNA, 31 bp, Artificial Sequence
  Single strand DNA oligonucleotide
aaaggatccgatatggagtgattggtggagc

SEQ ID NO: 9008 - DNA, 28 bp, Artificial Sequence
  Single strand DNA oligonucleotide
aaaggatcccaacgggtctgtcttgctc

SEQ ID NO: 9009 - DNA, 32 bp, Artificial Sequence
  Single strand DNA oligonucleotide
aaaggatcctgacgtaattcatagtgggaagc

SEQ ID NO: 9010 - DNA, 36 bp, Artificial Sequence
  Single strand DNA oligonucleotide
aaaggtaccctatttgctgctcctctgatacagaac

SEQ ID NO: 9011 - DNA, 39 bp, Artificial Sequence
  Single strand DNA oligonucleotide
tttgaattcttagcatccttatgctggtaggtaagattc

SEQ ID NO: 9012 - DNA, 34 bp, Artificial Sequence
  Single strand DNA oligonucleotide
tttggtaccttaagcaggatcacactatggtttg

SEQ ID NO: 9013 - DNA, 31 bp, Artificial Sequence
  Single strand DNA oligonucleotide
aaaggtaccgtgacttgcttcacaccttcag

SEQ ID NO: 9014 - DNA, 31 bp, Artificial Sequence
  Single strand DNA oligonucleotide
aaaggtaccgatcaacattcagacatgcacc

SEQ ID NO: 9015 - DNA, 34 bp, Artificial Sequence
  Single strand DNA oligonucleotide
aaaggtaccctaagattcacaacagccgactctc

SEQ ID NO: 9016 - DNA, 31 bp, Artificial Sequence
  Single strand DNA oligonucleotide
aaaaggcctcacgagctatgcatcatacagg

SEQ ID NO: 9017 - DNA, 34 bp, Artificial Sequence
  Single strand DNA oligonucleotide
aaaaggcctctatctcaatttcattggccctaac

SEQ ID NO: 9018 - DNA, 31 bp, Artificial Sequence
  Single strand DNA oligonucleotide
aaaggtaccacgctgatgatgttatggtgag

SEQ ID NO: 9019 - DNA, 31 bp, Artificial Sequence
  Single strand DNA oligonucleotide
aaaggtaccgtacagccactgatgttggatg

SEQ ID NO: 9020 - DNA, 31 bp, Artificial Sequence
  Single strand DNA oligonucleotide
aaaggtaccaggataatggaggatggagcag

SEQ ID NO: 9021 - DNA, 31 bp, Artificial Sequence
  Single strand DNA oligonucleotide
aaagaattcagctagcttattggtgtggctg

SEQ ID NO: 9022 - DNA, 31 bp, Artificial Sequence
  Single strand DNA oligonucleotide
aaaggtacctaagcttgcaagaggctcaaag

SEQ ID NO: 9023 - DNA, 31 bp, Artificial Sequence
  Single strand DNA oligonucleotide
aaagaattcgaactccttccacaccacaatc

SEQ ID NO: 9024 - DNA, 31 bp, Artificial Sequence
  Single strand DNA oligonucleotide
aaaggatccataccttgaggaacctggaacc

SEQ ID NO: 9025 - DNA, 30 bp, Artificial Sequence
  Single strand DNA oligonucleotide
aaaggtaccgctcgctctcccataataagc

SEQ ID NO: 9026 - DNA, 31 bp, Artificial Sequence
  Single strand DNA oligonucleotide
aaaggtaccacaagttcaccctgtatgttgc

SEQ ID NO: 9027 - DNA, 31 bp, Artificial Sequence
  Single strand DNA oligonucleotide
aaaggtacctattggccgcaagacaattaag

SEQ ID NO: 9028 - DNA, 31 bp, Artificial Sequence
  Single strand DNA oligonucleotide
aaaggtaccattcgtcgatgtccgatagaag

SEQ ID NO: 9029 - DNA, 35 bp, Artificial Sequence
  Single strand DNA oligonucleotide
aaaggtaccctagtagcagttcctcctcaacacag

SEQ ID NO: 9030 - DNA, 31 bp, Artificial Sequence
  Single strand DNA oligonucleotide
aaaggtaccaaactacgctgttacgctggtc

SEQ ID NO: 9031 - DNA, 34 bp, Artificial Sequence
  Single strand DNA oligonucleotide
aaaggtaccctagattaaagccagccaaacgaac

SEQ ID NO: 9032 - DNA, 35 bp, Artificial Sequence
  Single strand DNA oligonucleotide
aaaggtaccctataacagaaagacgagagcatgtg

SEQ ID NO: 9033 - DNA, 32 bp, Artificial Sequence
  Single strand DNA oligonucleotide
aaaggtacctgctactacagacagagacgagc

SEQ ID NO: 9034 - DNA, 35 bp, Artificial Sequence
  Single strand DNA oligonucleotide
aaaggtaccctatccagtccacatattacccaaag

SEQ ID NO: 9035 - DNA, 30 bp, Artificial Sequence
  Single strand DNA oligonucleotide
aaaaggcctagctcaattgtcacctgcatc

SEQ ID NO: 9036 - DNA, 32 bp, Artificial Sequence
  Single strand DNA oligonucleotide
aaagaattcagaacgcacgaacacagtacaac

SEQ ID NO: 9037 - DNA, 34 bp, Artificial Sequence
  Single strand DNA oligonucleotide
tttggatccctactaggcttgctctttctttggc

SEQ ID NO: 9038 - DNA, 31 bp, Artificial Sequence
  Single strand DNA oligonucleotide
aaaggtaccactacgtttcacccagtccatc

SEQ ID NO: 9039 - DNA, 31 bp, Artificial Sequence
  Single strand DNA oligonucleotide
aaaggtaccgaactctgctcgaagtgctacc

SEQ ID NO: 9040 - DNA, 33 bp, Artificial Sequence
  Single strand DNA oligonucleotide
aaaggtaccctatctgctattcaactcgcaagg

SEQ ID NO: 9041 - DNA, 27 bp, Artificial Sequence
  Single strand DNA oligonucleotide
aaaggtacccaatgccaagcccatcac

SEQ ID NO: 9042 - DNA, 34 bp, Artificial Sequence
  Single strand DNA oligonucleotide
aaaggtaccctactctgtctgaagactcacgagc

SEQ ID NO: 9043 - DNA, 31 bp, Artificial Sequence
  Single strand DNA oligonucleotide
aaaggtacctgcacgtcagcaaataaatctc

SEQ ID NO: 9044 - DNA, 31 bp, Artificial Sequence
  Single strand DNA oligonucleotide
aaagaattctgatcacaggaaataggcacag

SEQ ID NO: 9045 - DNA, 31 bp, Artificial Sequence
  Single strand DNA oligonucleotide
aaaggtacctcgtatcgtatcagcactcagc

SEQ ID NO: 9046 - DNA, 31 bp, Artificial Sequence
  Single strand DNA oligonucleotide
aaaggatccaccaaccaaacccatttatcag

SEQ ID NO: 9047 - DNA, 31 bp, Artificial Sequence
  Single strand DNA oligonucleotide
aaaggtaccccgcattattcaagcagatagc

SEQ ID NO: 9048 - DNA, 32 bp, Artificial Sequence
  Single strand DNA oligonucleotide
aaaggtaccctagattggatttgggtgtcgtc

SEQ ID NO: 9049 - DNA, 31 bp, Artificial Sequence
  Single strand DNA oligonucleotide
tttggtaccccgatgctggatcatgaattac

SEQ ID NO: 9050 - DNA, 31 bp, Artificial Sequence
  Single strand DNA oligonucleotide
aaaggtaccagctgatatctccacaacggac

SEQ ID NO: 9051 - DNA, 31 bp, Artificial Sequence
  Single strand DNA oligonucleotide
aaaggtaccaggactaaggcactgactgtgg

SEQ ID NO: 9052 - DNA, 31 bp, Artificial Sequence
  Single strand DNA oligonucleotide
aaaggtaccggagaggactatgtcaagcagg

SEQ ID NO: 9053 - DNA, 31 bp, Artificial Sequence
  Single strand DNA oligonucleotide
aaaggtacccacaaggacctacagcctgaac

SEQ ID NO: 9054 - DNA, 31 bp, Artificial Sequence
  Single strand DNA oligonucleotide
aaaggtaccaaatcagaagtgctatcccacg

SEQ ID NO: 9055 - DNA, 31 bp, Artificial Sequence
  Single strand DNA oligonucleotide
aaaggtacctgttctcgaaccaacaactgtc

SEQ ID NO: 9056 - DNA, 31 bp, Artificial Sequence
  Single strand DNA oligonucleotide
aaaaggcctgaacaattcacagggtttcgtc

SEQ ID NO: 9057 - DNA, 34 bp, Artificial Sequence
  Single strand DNA oligonucleotide
aaaggtaccctagtacgtacagctagcccgagac

SEQ ID NO: 9058 - DNA, 31 bp, Artificial Sequence
  Single strand DNA oligonucleotide
aaaggtaccaggtaaggtttcaaagccgaag

SEQ ID NO: 9059 - DNA, 35 bp, Artificial Sequence
  Single strand DNA oligonucleotide
aaaggtaccctatatagcagaactacggaccatcg

SEQ ID NO: 9060 - DNA, 31 bp, Artificial Sequence
  Single strand DNA oligonucleotide
aaaggtaccactcctcttcaattcatgctgc

SEQ ID NO: 9061 - DNA, 33 bp, Artificial Sequence
  Single strand DNA oligonucleotide
tttggtacctcatcacgatggctgcttattgtc

SEQ ID NO: 9062 - DNA, 31 bp, Artificial Sequence
  Single strand DNA oligonucleotide
aaaggtacctaggctaaccaaacaatgctgc

SEQ ID NO: 9063 - DNA, 36 bp, Artificial Sequence
  Single strand DNA oligonucleotide
aaaggtaccaaattgtgcagatactagcgtttacag

SEQ ID NO: 9064 - DNA, 34 bp, Artificial Sequence
  Single strand DNA oligonucleotide
aaaggatccctaacagcctaatctgcataggtgc

SEQ ID NO: 9065 - DNA, 35 bp, Artificial Sequence
  Single strand DNA oligonucleotide
aaaggtaccctaagccgaatagattggtaagttgc

SEQ ID NO: 9066 - DNA, 31 bp, Artificial Sequence
  Single strand DNA oligonucleotide
aaaggtaccaaacagccaccctctacacaac

SEQ ID NO: 9067 - DNA, 35 bp, Artificial Sequence
  Single strand DNA oligonucleotide
aaaggtaccctaccacttcaattcttctctgcctc

SEQ ID NO: 9068 - DNA, 31 bp, Artificial Sequence
  Single strand DNA oligonucleotide
aaaggtaccagcacaggtttctttccatcac

SEQ ID NO: 9069 - DNA, 31 bp, Artificial Sequence
  Single strand DNA oligonucleotide
aaaaggcctctgctctatccgctagacatcc

SEQ ID NO: 9070 - DNA, 34 bp, Artificial Sequence
  Single strand DNA oligonucleotide
aaagaattcctaaataatcacatcgcacagctcc

SEQ ID NO: 9071 - DNA, 31 bp, Artificial Sequence
  Single strand DNA oligonucleotide
aaaggtacccgcaggcttgacttaaacagag

SEQ ID NO: 9072 - DNA, 31 bp, Artificial Sequence
  Single strand DNA oligonucleotide
aaagaattctacacccacatgataaacgacg

SEQ ID NO: 9073 - DNA, 31 bp, Artificial Sequence
  Single strand DNA oligonucleotide
aaaaggcctgggaaacgagtccaatttgaag

SEQ ID NO: 9074 - DNA, 34 bp, Artificial Sequence
  Single strand DNA oligonucleotide
aaagagctcctaatacacacccatccgtgtatcc

SEQ ID NO: 9075 - DNA, 31 bp, Artificial Sequence
  Single strand DNA oligonucleotide
aaaggtaccgcaggacagcatactgctacac

SEQ ID NO: 9076 - DNA, 35 bp, Artificial Sequence
  Single strand DNA oligonucleotide
tttggtacctcatcactgtcgacagatatcgttgc

SEQ ID NO: 9077 - DNA, 31 bp, Artificial Sequence
  Single strand DNA oligonucleotide
aaaggtaccatacaaggtggctgatacggac

SEQ ID NO: 9078 - DNA, 31 bp, Artificial Sequence
  Single strand DNA oligonucleotide
aaaggtacctcctgagagccaacagaagaac

SEQ ID NO: 9079 - DNA, 31 bp, Artificial Sequence
  Single strand DNA oligonucleotide
aaaggtaccagcaatggcagataaatcaagc

SEQ ID NO: 9080 - DNA, 30 bp, Artificial Sequence
  Single strand DNA oligonucleotide
tttctcgagtgcctccctttgagctattcc

SEQ ID NO: 9081 - DNA, 29 bp, Artificial Sequence
  Single strand DNA oligonucleotide
aaagaattcaaacacgtcctctctggctc

SEQ ID NO: 9082 - DNA, 34 bp, Artificial Sequence
  Single strand DNA oligonucleotide
aaaaggcctcacatcagatgattctacatcctcc

SEQ ID NO: 9083 - DNA, 31 bp, Artificial Sequence
  Single strand DNA oligonucleotide
aaaggatcccttcagtctggcaaatcctctc

SEQ ID NO: 9084 - DNA, 31 bp, Artificial Sequence
  Single strand DNA oligonucleotide
aaaggtacccacagttgatcaattacccacg

SEQ ID NO: 9085 - DNA, 31 bp, Artificial Sequence
  Single strand DNA oligonucleotide
aaaggtaccattcgttcacacaaccagtagc

SEQ ID NO: 9086 - DNA, 31 bp, Artificial Sequence
  Single strand DNA oligonucleotide
aaaggtaccacgacatcctcgccagatatac

SEQ ID NO: 9087 - DNA, 31 bp, Artificial Sequence
  Single strand DNA oligonucleotide
aaaggtacctatgtactctgctgccaactgc

SEQ ID NO: 9088 - DNA, 34 bp, Artificial Sequence
  Single strand DNA oligonucleotide
aaaggtaccctatgtttggacatggcagtgtaag

SEQ ID NO: 9089 - DNA, 31 bp, Artificial Sequence
  Single strand DNA oligonucleotide
aaaggtaccctgcctatgggcgatatagttg

SEQ ID NO: 9090 - DNA, 31 bp, Artificial Sequence
  Single strand DNA oligonucleotide
aaaggtaccagagagactcctcagccatcag

SEQ ID NO: 9091 - DNA, 31 bp, Artificial Sequence
  Single strand DNA oligonucleotide
aaaggtaccctgctctacgctagtgcgaatc

SEQ ID NO: 9092 - DNA, 31 bp, Artificial Sequence
  Single strand DNA oligonucleotide
aaaggtaccagtagggacgaaacaagcacag

SEQ ID NO: 9093 - DNA, 34 bp, Artificial Sequence
  Single strand DNA oligonucleotide
aaaggtaccctagcttgtgaaatacgctttccag

SEQ ID NO: 9094 - DNA, 31 bp, Artificial Sequence
  Single strand DNA oligonucleotide
aaaggtaccagcatacaaggctcaattccag

SEQ ID NO: 9095 - DNA, 31 bp, Artificial Sequence
  Single strand DNA oligonucleotide
aaaggtaccctacagcgtgcagaaaacgaag

SEQ ID NO: 9096 - DNA, 506 bp, Gossypium raimondii
atactttggaaaaagcttgtacagtttgggaaggggttttgattgatcgatcaaaaagaagaatttacttcaactgatatgcccttaggcacggccatgcataacatagaaaccacacttggaaggggtggacaattagctagagcagcgggtgctgttgcgaaactgattgcaaaggaggggaaatcggccacattaaaattaccttctggggaggtccgtttgatatccaaaaactgctcagcaactgtcggacaggtggggaatgttggggtgaaccagaaaagttcgggtagagccggatctaaatgttggctaggtaagcgtcctgtagtaagaggagtagttatgaaccctgtagaccatccccatgggggtggtgaagggagggctccaattggtagaaaaaaacccgcaaccccttggggttatcctgcacttggaagaagaagtagaaaaaggaataaatatagtgataatttgattcttcgtcgacggagtaaata

SEQ ID NO: 9097 - DNA, 613 bp, Amaranthus tuberculatus
ggggggggtcataagcgtctataccgtaaaatcgattttcgacggaatgaaaaagacatatatggtagaatcgtaaccatagaatacgaccctaatcgaaatgcatacatttgtctcatacactatggggatggtgagaagagatatattttacatccccgaggggctataattggagataccattgtttctggtacagaagttcctataaaaatgggaaatgccttacctttgaccgatatgcccttaggcacggccatacataacatagaaatcacacttggaaagggtggacaattagctagagcagcgggtgctgtagcgaaactgattgcaaaagaggggaaatcggccacattaaaattaccttctggggaggtacgtttgatatccaaaaactgctcagcaacagtcggacaagtgggaaatgttggagtgaaccagaaaaggttgggtagagccggatctaagcgttggctaggtaagcgtcctgtagtaagaggagtagttatgaaccctgtagaccatccccatgggggtggtgaggggagggccccaattggtagaaaaacccacaaccccttggggttatcctgcacttggaagaagaagt

SEQ ID NO: 9098 - DNA, 2749 bp, Lippia dulcis
aaaaaaaagtttttcgcgggcgaatatttactcttgcaatctctatttcagtcgtagcacttgttcgtgacttctcagaatagatgaattgatttatggttcatttcgccatcccgactagtaaatcagtaagattcatttgttcaataaaatcttttgcattcacaggttctatcgttcccaccgcttcgtacttaatgcttaggtcagaattctacaacggagctcacaattcaatttattcttgagtcaatcttcttagtctttattggctcgaagctcttgattttcttcttctataagaaggattcattgaaaaatgaatcaattagtattgatgctttattacactgtcttttttgtagatgacttatagaccctacatgttggaattctatatcattgctattctttttctctctttctctcatccttccatttcatttttccacacctttcttcgtttaaacttggaagaaagtttattcaaaaaaaaatagtcagttgctacaaagatatgaccgattctcatatcttgaccggtttttagatccagataatacgaagtaatgggttggtttttatactaccgggctggtgttttttgaatcctaaccctaaatcaaaaaaaaaccaacgagtcacacactaagcatagcaattctatcaaaaggaaaatcgaatttttattcaaccctataaaattaagcgaattggtttgattggccagaacaagaatgaactagtttcccttttttgttcaatcaatggatagaagggaaaagcaatgaaagttttcttattcctcttctttgtctataaaaatccaaattttgatacctaatacccccatagatggtccgaactgtataggaacaataatcaattttagctcgaatggtttgtaggggaaccctaccctctctgatccattcgacacgtgcaatttcttttccgtcgatacgcccggcaatttgtacttgaattccttttgtatctgcttgttcagttaattcaatagcctttttcattgcttttcggaaggaaaccctattctttaattgtccggctataaattctgcaagaattttggggtttccataaggttttgcaattcttaggatagcaatgttcagttttcggtttacataatgaaattctttttgtagattcatctgtaattcttcgattcctcgcggtctattttcaattaagagctttgggaatcccataaagattatgacctgtatcaaatcgattcttttttgaatctctatacgggcaattccctctgcgccggaggatgttcttatattcttttgtacataattttggatcaaatctcttattttttgatcttcttgtagaccttgagaataattttttggttgtgcaaaccaaagtgaatgatgactttgggttgtaccaagtctgaaaccaagtggatttattttttgtcccatactaccccactactatacacatcataatatgtcatagttgtctttttccatctagacttttttaaggaatatagctcttcatattcatattcatctaaagatacatctttcactccaatagttatatgacaggtagttcgttttatcgcataactacgcccccgagctcgaggtttgaatttcttcctagcattgccctcgttaacctcagctttactaatgactagattggcttcgtcggaacccatattgtaactagcatttgctgctgcagaataaaccaatttaaaaatgggataacatgctctatagggcatcagttctaggatcataagtgtttcctcataggaacgtccgcggatttgatcaattactcttcttgctttgtcagcagatagagatatatgtcgccctaaagcgtatatttccgttttgttcttttttatccttagcataaggttctctcctactaatgaatcataagtaccgatctatatgttttttaaaataagattaacgacgagatctattatcactttttgcatgtcctcggaaattgaaagtaggtacaaattctcccaatttgtgacctaccatacgatctgttatataaataggcaaatgttccttaccattatgaatagcaatcgtatggccgatcattgtaggtataatggtagatgcgcgggaccaagttactattatttctttttctgcttttttattaatcttatcaatttttcttaatagatgattggccactaaaagggtttttttttagtgaacgtatcacagcttactcctattttttttgttttgtaaagacgaagaaagaaattcgattttctcgcctatttactacggcgacgaacaatcaaattatcactgtatttctttctttttctacttcttcttccaagtgcaggataaccccaaggggttgtgggtttttttctaccaattggggctctcccttcaccacccccatggggatggtctacagggttcataactactcctcttactacaggacgcttacctagccaacgcttggatccggctctacccaaacttttctggttcgccccaacattccccacttgtccgactgttgctgagcagtttttggatatcaaacggacctccccagaaggtaattttaatgtggccgatttcccctcttttgcaatcagtttcgctacagcacccgctgctcgaactaattgtccaccctttccaagtgtgatttctatgttatgtatggccgtgcctaagggcatatcggt

SEQ ID NO: 9099 - DNA, 548 bp, Panax ginseng
acagtttgggaaggggttttgattgatcaaaaagaagaatctacttcaaccgatatgcccttaggcacggccatacataacatagaaatcacacgtggaaagggtggacaattagctagagcagcgggtgctgtagcgaaactgactgcaaaagaggggaaatcggccacattaaaattaccttctggggaggtccgtttgatatccaaaaactgctcagcaacggtcggacaagtggggaatgttggggtgaaccagaaaagtttgggtagagccggatctaagcgttggctaggtaagcgtcctgtagtaagaggagtagttatgaaccctgtagaccatccccatgggggtggtgaagggagggccccaattgggagaaaaaaaacccacaaccccttggggttatcctgcacttgggagaagaagtagaaaaaggaataaatatagtgataatttgattcttcgtcgccgtagtaaataggagagaaaatagaatttatttcttcgtctttacaaaaaaaataggagtaagctgtgacacgttc

SEQ ID NO: 9100 - DNA, 1257 bp, Fragaria vesca
ttatcccattctattttggtagttcgaccgtggaatttatttttttctgtatttccggaatatgagtgtgtgacttggtataattgatcctatggctagtacagagaatagatctgtcatcttgatagagatggttttacttcgtcggatattcattttagtatctggagcacggaatatatgaaatagattactattagaactatgattcatacttaatagttagacctcgtggccggacttcaaaatttttttaaagagttagaagttataaatagaattttttttatttcaaacttccgtttagacttattttgatcaaaggacaaagatttcttttgatttttcgtcattagatctagtcattgaataagtgatgatccaatggttcttactcagggaattttgggacttagtttgagaaggttttattgaatcatcgtggttctagtatgaatctgcggttttaatcgattcatagggtcttaacaagagaattcctatcaataaaatcaataaaaaaacagcagtaaagccgcagtacacataaataacaacaaagaaaataggtaaatagaagattcaagaggcctataacgagcaatatagagatgaatgagccgacttgattttttggcattataaccacaaagaatagtttttgggttttttattctttcatatcttaagaaaaaaggaatcgtagaattaataaatttaaaactttctattccacacatctgttcccttaggcacggccatacataacatagaaatcacacttggaaagggtggacaattagctagagcagcaggtgctgtagcgaaactgattgcaaaagaggggaaatcggccacattaaaattaccttctggggaggtccgtttgatatccaaaaactactcagcgacagtcggacaagtggggaatgttggggtgaaccagaaaagtttgggtaaagccggatcaaaatgttggctaggtaagcgtcctgtagtaagacgagtagttatgatgtagaccatctccatgggggtggtgaagggagggccccaattggtagaaaaaaacccgcaaccccttggggttatcctgcacttggaagaagaagtagaaaaaggaataaatatagtgataatttaattcttcgtcgccgtagtaaataggcgagaaaatataatttatttcttcgtcttaaaaaaaaatattagggtgaacgaccggaattgaacccgcgcatggtggattcacaatcc

SEQ ID NO: 9101 - DNA, 746 bp, Medicago truncatula
acgaaatcgtttgatttatggacagcatcattgtggtaaaggccgtaatgccagaggaatcattaccgcagggcatagagggggaggtcataagcgtctataccgtaaaattgattttcgacgtaatgaaaaagacatatatggtcgaatcgtaactatcgaatacgaccctaatagaaatgcacacatttgtctcatacactatggggatggtgagaaaagatatattttacaccccagaggggctataattggagataccattgtttatggtacagaagttcctataaaaatgggaaatgccctacttcaaccgatatgcccttaggcacggccatacataacatagaaataacacttggaaagggtggacaattagctagagcgcctggtgctgtagcgaaactgattgcaaaagaggggaaatcggcaacattaaaattaccttctggagaggtccgtttgatatcaaaaaactgctcagcaacagtaggacaagtagggaatgttggagtaaaccaaaaaagtttgggcagagccggagctaaacgttggttaggtaagcgtcctgtagtaagaggagtagttatgaaccctgtagaccatccacatggtggtggtgaagggagggccccgattggtagaaaaaaaccctcaactccttggggttatcctgcacttggaagaagaagtagaaaaaaaaaaaatatagtgataatttgattcttcgtcgccgtagtaaatag

SEQ ID NO: 9102 - DNA, 608 bp, Trifolium pratense
accgatatgcccttaggcacggccatacataacatagaaataacacttggaaggggggggcaattagctagagcagcaggtgctgtagcgaaactgattgcaaaagaggggaaatcagcaacattaaaattaccttctggagaggtccgtttgatatccaaaaactgctcagcaacagtcggacaagtagggaatgttggggcaaaccagaaaagtttgggcagagccggagctaaacgttggctaggtaagcgtcctgtagtaaggggggtagctatgaaccctgtagaccatccacacgggggtggtgaagggaaggccccaattggtagaaaaaaaccctcaactccttggggttatcccgcacttggaagaagaactagaaaaaggaataaatatagtgataatttgattcttcgtcgccgtagtaaatagtgtagagtagagaaaatacaatttgttttttcgtctttacaaaagaaaaaaaaaaacggatttactaaaatcattatatgattttcttttttgaaagatcatatcattttatttttaaaaatagttttcgaaattggaggacaaataattaactatgacacgttcacaaaaaa

SEQ ID NO: 9103 - DNA, 788 bp, Centaurea maculosa
cgtaatttatagagtcattcggtctgaatgctacatgaagaacataagccagatgatggaacgggaagacctaggatgtagaagatcataacatgagtgattcggcagattttgattcctatatatccacccatgtggtacttcattataccatatatataagatccatctgtatagatatcaccatctacatccagaaagccgtatgctttggaagaagcttgtacagtttgggaaggggttttgattgataaaaaagaagaatctacttcaaccgatatgcccttaggcacggccatacataacatagaaatcacacttggaaagggtggacaattagctagagcagcgggtgctgtagcgaaactgattgcaaaagaagggaaatcggccacattaaaattaccttctggggaggtccgtttgatatccaaaaactgctcagcaacagtcggacaagtggggaatgttggggtgaaccagaaaagtttgggtagagccggatctaagcgttggctaggtaagcgccctgtagtaagaggagtagttatgaaccctgtagaccatccacatgggggtggtgaaggaagggccccaattggtagaaaaagacccacaaccccttggggttatcctgcacttggaaaaagaagtagaaaaaggaataatatagtgataatttgattcctcgtcgccgtagtaaataggagagaaaatagaatttctttcttcgtctttacaaaaaaaaataggaggaagctgtgacacgttcgctaaaaaaaaatctt

SEQ ID NO: 9104 - DNA, 1012 bp, Cajanus cajan
gaattaataaaggctaaaaattcaggtagaaatctttcttgtatagtataagggcggatgtagccaagtggattaaggcagtggattgtgaatccaccatgcgcgggttcaattcccgtcgttcgcccattcatataaaaaaatataaattattcgctacataaggatttttttttagtgaacgtgtcacagttaattactcctttttcttgtaaagacgaagaaacaatttcaattttctctactatttactacgacgacgaagaatcaaattatcactatatttattcctttttctacttcttttcccaagtgcaggaaaaccccaaggagttgcgggtttttttctaccaattggggccctcccttcaccacccccatgcggatggtctacagggttcataactactcctcttactacaggacgcttacctagccaacatttagatccggctctacccaaatttttctggtttacccccacatttcccacttgtccgactgttgccgagcagtttttggatatcaaacggacctccccagaaggtaattttaatgtggctgatttcccctcttttgcaattagtttcgctacagcacctgctgctctagctaattgtccaccctttccgagtgtgatttctatgttatgtatggccgtacctaagggcatatcggttgaagtagattcttctttttgatcaatcaaaaccccttcccaaactgtacaagcttcttacaaagcatacggctttctggatgtagatgatgatatctatacagatggatcttatatggatatatctatctatatctatatcgcacaatgaagtaccgcacgagtgggtatataggaatccaaatctgccgaatcactcatgttatgatcttctacatcctaggtcttcccgttccttcatctggcttatgttcttcatgtagcattcagactgaatgactctatgaaattacgtcgctacttccacacggtacgggtaacgtaggagacatc

SEQ ID NO: 9105 - DNA, 592 bp, Lotus japonicus
gggaaaatcgtaaccctggaatacgtccctaatcgaaatgcatacatttgtctcatacactatggggatggtgagaaaagatatattttaccccccagaggggctataattggagataccattgtttctggtacagaagttcctataaaaatgggaaatgccctacctttgagcacggccatacataacatagaaatcacattcggaaagggtggaaaattagctagagcagcaggtgctgtagcgaaactgattgcaaaagaggggaaatcggcaacattaaaattaccttctggggaggtccgtttgatatccaaaaactgctcagcaacagtcggacaagtaggaaatgttggggtaaaccagaaaagtttgggcagggccggatcgaaatgttggctaggtaagcgtcctgtagtaagaggagtggttatgaaccctgtagaccacccccatggggggggtgaagggagggcccccattggtagaaaaaaacccgtaactccttggggttatcctgcacttggaagaagaagtagaaaaaggaagaaatatagtgataatttgattcttcgtcgccgtactaaatagt

SEQ ID NO: 9106 - DNA, 837 bp, Lippia dulcis
tagagatgtctcctacgttacccataatatgtggaagtatcgacgtaatttcatagagtcattcggtctgaatgctccatgaagaacataagccagatgacggaacgggaagacctaggatgtagaagatcatcccatgagtgattcggcagatttggattcatatagatatccacccatgtggtacttcattgtaccatatatatatataagatccatctgtatagatatcatctacatccagaaagccgtatgctttggaagaagcttgtacagtttgggaaggggttttgattgatcaaaaaagaggaatctacttcaaccgatatgcccttaggcacggccatacataacatagaaatcacacttggaaagggtggacaattagttagagcagcgggtgctgtagcgaaactgattgcaaaagaggggaaatcggccacattaaaattaccttctggggaggtccgtttgatatccaaaaactgctcagcaacagtcggacaagtggggaatgttggggcgaaccaaaaaagtttgggtagagccggatccaagcgttggctaggtaagcgtcctgtagtaagaggagtagttatgaaccctgtagaccatccccatgggggtggtgaagggcgagccccaattggtagaaaaaaacccacaaccccttggggttatcctgcacttggaagaagaagtagaaaaaggaataaatatagtgataatttgattgttcgtcgccgtagtaaataggcaagaaaatcgaatttctttcttcgtctttacaaaaacaaaaaaaataggagtaagctgtgatacgttcactaaaaaaaa

SEQ ID NO: 9107 - DNA, 7135 bp, Arnica chamissonis
tccaatggatttaaaacttattttcggtaaatcaattacgaaattttttctagaatccctaaaatttgtttgacatcttctatgcgaaaatgttccattttcataagatcttcttgactgttattcaaaaggtccaataatgtatatatgttggaccttttgaggcaattatagattctgggaggcaattctgattggtcaataaaaatcgatttcaacgccattttttttttattttttgttagtttagccaatttatcataaaaggtaaaagggggtaaaggaactatgtgttgattgtcctctaaatttaaattttcttctttggtatgtaaaaagggaatcaataaatcaatcaaattccgggaggcttcgtgaagtgcttctttaggagttaaacttccatttgtccatatttcgagaaatagtatctctttgttaccattttcataagaatgaatactatgattcgcatttcgaacaggcatgaatataggatctataggataacttccatcttgaaaggtatttggcgcttttataagatatccacgattcttctctatttgtaatccaataaccaactcaatgggttccgtcaagctagctatatgctgtgtattatcgacgatttctacataaggcggtaagatgatatcttgagcagttacatatccagggcccctgacacaaatagacgcctcacaagttccatagagattacttttcaatacgatttctttcaaattcattaaaatttcatgtactgattcttgaatacccattatggtagaatattcgtgtgagattttatcaaattttgcgcgtgtgatacatgttccttcgatttctccaagcaaagctcttcgcatcgcaatgcctattgtgtctgcttgacctttcataagcggagacagaataaagcgcccatacaaaagacgcttactgtctgctgctgattcaacacacttccactgtagtgtccgagtagatactgttattttctctcgaaccataataatattatttgatctgatcattgaatcatttatttctcttgtttctcttgctattgaaatatcttcaatttttatttctacacacgtctttttttcgggggtctacagccattatgtggcataggggttacatctcgtacgaaagttaatagtataccacttctgcgaatagctcttaatgctgcgtctcttccgagaccgggacctttaatcatgacttctgctcgttgcataccttgatctactactgcacgaatagcatttgccgctgcggtttgagcagcgaatggcgtccctcttcttgtacctcggaagccacaagtaccggcagaggaccaagaaaccactcgccctcgtacatctgtaacagtcacaatggtattattgaaacttgcttgaatatgaataaccccctttggtattttacgtatactcttacgtgaaccaatacgtccacgtgaaccctttttcggtatagcttttgccatattttatcatctcataaatttgagtcagagatatatggatatatccatttcatgtcaaaaaaagatcccccttcttatttgtatattgggtctttaacgagtcttattatccttgtctttgtttatgtcttgggttggaacaaattactataattcgtccccgacgacggattagtcgacatttttcacaaattttacgaacagaagctcttattttcatatttgccactccttactttaattttgaatccctttcttggaagaaaataagtttctttcaattttcgatttcgaatcgtattcctgcgaaagaaatagtgaagttgaaaaaacacctaatctttcgaatctttgttgcggagtcgataaattatacgacctctggttgaatcataacgacttacttcaattttgactctatctcctggcaatattcgtataaaactacgtcggatctttcctgaaacataacctagaatcatatcttcattatctaaacgaacccggaacatgccgttgggaagcgattcagtaattaaaccttcatgaatccatttttgttctttcattccaggtaaaacctccttgaagtatcaactagtggaggaagaaccctattagacaacccaccccttctcttttctttttcacaaaaaagaagtttcctattcaattcggatattagaaagattaccatatataacacaaaatttctccgcctattctttctagtcgagcctcccggtctgtcattataccccgagaggtagaaagaattacaacccccatcccgcctaaaattctaggaattctttgatagttagaatagattcgtagacccggccgactgatccgttttaaatttaaaagatttcgataagtccttttcctattccttctatgtcgtagggttaaaaccaaaaaagctttgttgttttctcgatgttctctcacgttttcgataaaaccctctcgtaaaagtattttaacaatactttggcttatattagtaaatgctactcgaaccacgctttttctatacatatcggcatttcgtatagaggttattatgtcagcaatagtatcactacccatgattaattaaaattattggtgcctccaaatttggatataatcaacatgtttttatttcttttttttacgtatttttttatgaatattcatatgaattttgaaaggtatatacgtgagacaaatctactaaattaatcttaatctatttcttgaaataccctactataacctataaccatatcgtggtctcattttataatacctcgggagctaatgaaacaattttagtaaaattgaactgtctcaattctcgggcaatcgcaccaaaaactcgagttccttttggatttccttcttgatcaatcacaactgcagcattgtcatcatatcgtattatcataccgttgtcacgtttaagttctttacaagtacggacaattacagctctgaccacttctgatctttctaaaggcatgtttggaactgcgtctttgatcacagcaacaataacgtcaccaatatgagcatatcgacgattgctagctcctatgattcgaatacacatcaattttcgagccccgctattatctgctacattcaaataggtctgaggttgaatcatatcatttttttatctgttttttacaatacaaaggtcgaagaaaaaaagaaatattatttgttcaaaaaagaaacctgcacccgctatttttaaggcctatttcttttttatcccgaaatgatgaattgagctcgtataggcattttggacgctgctattgaaatagcccttctggctatattttctgttactccacccatttcataaaggattcgacctggtttaacaacagctacccaatattcgggagagcctttacctgaacccatacgtgtttctgcgggccttactgtaactggtttatctggaaatatacggacccatatttttccaccgcgacgtgcatttcgtgtcattgctcgtcgacctgcttctatttgtctagatgtgatccaagcgggttcaagtgcctgaagagcgtatttaccaaaacaaatagtattacctcgataagatattcccttcattcttcctctatgttgtttacggaatctggttcttttgggactaagcatagcaattttatcaaaagatttattgaatttttattcaaccttatagaattataattgttccttttttttattgaacacaaaagaaaaagaagaaactaatttctcattttttgttccatcgctggatagaatgcaaagggaaataaaggtttattattccccttctataaatatccaaattttgatgcctaataccccatagattgttcgaactgtataggaacaataatcaattttagctcgaatggtttgtagtggaaccctaccctctctgatccattcaacacgcgcaatttcttttccgtcgatacgtcctgcaatttgcacttgaattccttttgtatctgcttgttcagttaattctatagcctttttcattgctttgcgaaaagaaactctattttttaattgtccggctataaattctgcaagaatattagggtttccataaggcttttcaattcgtgtgatagcaatgttaagttttcgatttacagaattaaattctttttgtaaattcatctgtaattcttcgattcctcggggtcgactttcaattaatatttttggaaatcccatatagattatgatttggatcaggtcgattcttttttgaatctctatacgtgcaattccctcgacgccagaagatgttttcatatttttttgtacataattctttatataatttcttattttttgatcttcttgcagaccctcagaataattttttggttgtgcgaaccaaagggaatgatgaccttgggttgtaccaagtctgaaaccaattggatttattttttgtcccatgttcccccattactatacatatcataatacgacatagttgtatccttttttttcttttgtgaccatgtaatagagtcggtatctatatattcatctaaggatatatctttcattacaatagtgatatggcaggtaggtttttgtatcgcaaaactacgccctcgagctcgatgttttaatctcttcatgatagtacctttatttacttcggctttactaatcactaaatttgcttcattcgaacccatattggaactagcatttgctgctgcagaataaactaatttaaaaatgggataacatgctcgataaggcatgagttctaatatcataagtgtttcttcgtaggaacgcccacgaatttgatcaattactcttcgcgctttgtcagcagacatagatatatgttgacctaaagcgtatacttctgttgttctcttatttaacatcaagttcgcctcctactataaatatctatatatattattatacataaacaaacgttttttaacgacgagatctattatcgctttttgcatgtcctcggaaatttaaagtaggcgcaaattctcccaatttgtgtcctaccatacgatctgttatataaataggtaaatgttcctttccattatggatagcaatggtatggccgaccattatgggtataatggtagatgcccgggaccaggttattattatttctttttcttcttttgtgttaagcttatttattttttttaataaattattcgctacaaaaggatttttttttagtgaacgtgtcacagcttcctcctatttttttttgtaaagacgaagaaagaaattctattttctctcctatttactacggcgacgaagaatcaaattatcactatatttattcctttttctacttctttttccaagtgcaggataaccccaaggggttgtgggtctttttctaccaattggggccctcccttcaccacccccatgtggatggtctacagggttcataactactcctcttactacagggcgcttacctagccaacgcttagatccggctctacccaaacttttctggttcaccccaacattccccacttgtccgactgttgctgagcagtttttggatatcaaacggacctccccagaaggtaattttaatgtggccgatttcccttcttttgcaatcagtttcgctacagcacccgctgctctagctaattgtccaccctttccaagtgtgatttctatgttatgtatggccgtgcctaagggcatatcggttgaagtagattcttcttttttatcaatcaaaaccccttcccaaactgtacaagcttcttccaaagcatacggctttctggatgtagatggtgatatctatacagatggatcttatatatatggtataatgaagtaccacatgggtggatatataggaatcaaaatctgccgaatcactcatgttatgatcttctacatcctaggtcttcccgttccatcatctggcttatgttcttcatgtagcattcagaccgaatgactctatgaaattacgttgatacttccacatattatgggtaacgtaggagacatctctatttttccccccgggaatctttagaattaccactgcttagctttcaattcgcctctgaccatcaaatgaaatgtgaataatccgtcctcttctctttgaaagaaggggcgcttccggttctgtcggtgcttgaaacaattttgtcttctccatattactatatctctagagtcaataattttatatgaggaactactgaactcaatcacttgctgccgttactcttcagttttctgttgaggtctatcctgtagaggtactcaaattggatcagtgatcgatttctaggtttcgtcgtaaacctaattggttacttccaattacgtaaatcaatagttcaaaccgcactcaaacggtcaaaggtagggcatttcccatttttataggaacttctgtaccagaaacaatggtatctccaattatagcccccctgggatgtaaaatatatctcttctcaccatccctatagtgtatgagacaaatgtatgcatttcgattcgggtcgtattctatggttacgattctaccatatatgtctttttcattccgtcgaaaatctattttacggtatagacgcttatgacctccccctctatgccctgcggtaatgattcctctggcattacgacctttaccacaatgatgctgtccatagatcaaattatttcgtggattggatttcacttgactgtctacggttccattgcgtgtgctcggggtagaagttttgtataaatgtatcgccatgctattaagtattttgatttaagttcttttctttctaagaggtggaatagaataacccggttgaagcgtaattatcatacgtctgtaatgcattgtctgtcccataatgggtcccattcttctagcctttccccgaagtcgatgactattcatcgcgattaccttgacaccaaagaagagttcgacccaatgctttatttctgtcctagttgatcctgattcgacattaaaagtatattgatttttccccaataaccgaatacttttgtctgtaaatactgcatacctgattccatccataaatcgat

SEQ ID NO: 9108 - DNA, 9975 bp, Ricinus communis
aataggtaaatgctcctttccattatggatagcaatagtatggccgatcattgtgggtataatggtagatgcccgggaccacgttactattatttctttttctgcttttgtgttaagcttatttattttttttaataaatgatttgctacaaaaggatttttttttagtgaacgtgtcacagtgaatttctcctattttttttttttttttatttattttgaaaagacgaagaaacaaattctattttttctcctatttactacggcgacgaagaatcaaattatcactatatttattcctttttctacttcttcttccaagtgcaggataaccccaaggggttgcgggtttttttctaccaattggggccctcccttcaccacccccatggggatggtctacagggttcataactactcctcttactacaggacgcttacctagccaacatttagatccggctctacccaaacttttctggttcaccccagtattccctacttgtccgactgttgctgagcagtttttggatattaaacgaacctccccagaaggtaattttaatgtggccgatttcccctcttttgcaatcagtttcgctacagcacctgcagctctagctaattgtccaccctttccaaatgtgatttctatgttatgtatggccgtgcctaagggcatatcggttgaagtagattcttctttttgatcaatcaaaacctcttcccaaactgtacaagcttcttccaaagcatacggctttctgggtgtagatgatgatatctatacagatggatcttatatatcgtaaaatgaaaaaaagtactacatgagtggatatataggaatcaaaatctgctgaatcgctcatgttatgctcttctacatcctaggtcttcccgttccttcatctggcttatgttcttcatgtagcattcagaccgaatgactctatgaaattacgtcgatacttccacatattaggggtaacgtaggagacatttctattttttccccggggaatctttagaattaccactgcttagctttcaattcgcctctgaccatcaaatgaaatgtgaataacccgtcctcctctctttgaaacaaggggtgcttccggttctgtcggtgcttgaaacaattttgtcttctccatattactatatctctagagtcaataattttctatgaggaactactgaactcaatcacttgctgccgttactcttcagttttctgttgaggtctatcctgtagaggtactcaatttggatcagtgatcgatttctaggtttcgtcgtaaacctaattggttacttccaattacgtaaatcaatagttcaaaccgcactcaaaggtagggcatttcccatttttataggaacttctgtaccagaaataatggtatctccaattatagcccctctgggatgtaaaatatatctcttctcaccatccccatagtgtatgagacaaatgtatgcatttcgattagggtcgtattctatggttacgattctcccatatatgtctttttcattccgtcgaaaatcgattttacggtatagacgcttatgacctccccctctatgccttgcggtaatgattcctctggcgttacggcctttaccacaacgatgctgtccatagatcaaattatttcgtgtatttcgtgtattggatttcacttgactgtctacggctccattgcgtgtgctcggggtagaagttttgtataaatgtatcgccatgctattaagtattttgatttaagttcttttctttctaagaggtggaatagaataacccggttgaagagtaatgatcatacgtctgtaatgcattgtatgtcccataataggtctcattcttctaccctttcccgggagtcgatggctattcatagctattaccttgacaccaaagaagagttcgacccaatgctttatttctgtcctagttgatcctgattcgacattaaaagtatattgatttttccccaataaccgaatacttttgtctgtaaatactgcatatttgattccatccataaatctattttcttccctatgagttctagtctcaataagaatgctagttcttactgttcatatgttatgatatgaatataccacaccaattcgttatgtatggatgatgagattccattgatacagagccaattccagtagacttattggagggtcccattggcgtgcatccagtaggaattgaacctacgaattcgccaattatgagttgggcgctttaaccattcagccatggatgcttagcggggatcctcgtacatggtgaataaccaaattccaattgaaatgaaatctttaggataaatcaatgcaatttaggaggaatcaatgaaaggacatcaattcaaatcctggattttcgaattgagagagatattgagagagatcaagaattctcactatttcttagattcatggacccaattcaattccgtgggatctttcattcacatttttttccatcaagaacgttttataaaactcttggactcccgaatttggagtatcttactttcacgcaattcacagggttcaacaagcaatcgatatttcacgatcaagggtgtagtactatttgtagtagtggtccttatatatcgtattaacaatcgaaagatggtcgaaagaaaaaatctctatttgacagggcttcttcctatacctatgaattccattggacctagaaatgatacattggaagaatccttttggtcttccaatatcaataggttgattgtttcgctcctgtatcttccaaaaggaaaaaagatctctgagagctctttcctggatccgaaagagagtacttgggttctcccaataactaaaaagtgtatcatgtctgaatctaactggggttcgcggtggtggaggaactggatcggaaaaaagagggattctagttgtaagatatctaatgaaaccgtcgctggaattgagatctcattcaaagaaaaagatatcaaatatctggagtttctttttgtatattatatggatgatccgatccgcaaggaccatgattgggaattgtttgatcgtctttctccgaggaaggggcgaaacataatcaacttgaattcgggacagctattcgaaatcttagtgaaagactggatttgttatctcatgtttgcttttcgtgaaaaaatatcaattgaagtggagggtttcttcaaacaacaaggagctcggtcaactattcaatcaaatgatattgagcatgtttcccatctcttctcgagaaagaagtgggctatttctttgcaaaattgtgctcaatttcatatgtggcaattccgccaagatctcttcgttagttgggggaataattcgcacgaatcggatttttttaggaacatatcgagagagaattggatttggttagacaatgtgtggttggtaaacaaggatcggttttttagtaaggcacggaatatgtcgtcaaatattcaatatgattccacaagatctagtttcgttcaaggaaggaattctagccaattgaagggatcttctgatcaatccagagatcatttcgattccattagtaatgaggattcggaatatcacacattgatcaatcaaagaaagattcaacaactaaaagaaagatcgattctttgggatccttcctttcttcaaacggaacgaacagagatagaatcagaccgattccctaaatgcctttctggatattcctcaatgtcccggctattcacggaaggtgagaaggagatgaataatcatctgcttccggaagaaatcgaagaatttcttgggaatcctacaagatccattcgttcttttttctctgacagatcgtcagaacttcatctgggttcgaatcctactgagaggttcactagagatcagaaattgttgaagaaagaacaagatgtttcttttgtcccttccaggcgatcggaaaataaagaaatagttaatatattcaagataatcacgtatttacaaaataccgtctcaattcatcctatttcaccagatccgggatgtgatatggttctgaaggatgaactggatatggacagttccaataagatttctttcttgaacaaaaatccattttttgatttatttcatctattccatgatcggaacggggggggatacacgttacaccgcgattttgaatcagaagagagatttcaagaaatggcggatctattcactctatcaataaccgagccggatctggtgtatcataagggatttaccttttttattgattcctacggattggatcaaaaacaattcttgaatgaggtattcaactccagggatgaatcgaaaaagaaatctttattggttctacctcctattttttatgaagagaatgaatctttttatcgaaggatcagaaaaaaatgggtccggatctcctgcgggaatgattttgaagatccaaaacaaaaaatagtggtatttgctagcaacaacataatggaggcagtcaatcaatatggattgatcctaaatctgattcaaatccaatatagtacctatgggtacataagaaatgtattgactcaattctttttaatgaatagatccgatcgcaacttcgaatatggaattcaaagggatccaataggaaatgatactctgaatcatagaactataatgaaatatacgatcaaccaacatttatcgaatttgaaacagagtcagaagaaatggttcgatcctcttatttttctttctcgaaccgagagatccatgaattgggatcctaatgcatatagatacaaatggtctaatgggagcaagaatttccaggaacatttggaacatttcatttctgagcagaagaaccgttttctttttcaagtagtgttcgatcgattacgtattaatcaatattcgattgattggtctgaggttatcgacaaaaaagatttgtctaagtcacttcgtttctttttgcccaagttacttctttttttgtccaagtttcttctctttttgtctaactcacttccttttttctttgtgagtttcgggaatattcccattcataggtccgaaatccatatctatgaattgaaaggtccgaatgatccactctgcaatcagctgttagaatcaataggtcttcaaatcgttcatttgaaaaaatggaaacccttcttattggatgatcatgatacttcccaaaaatcgaaatttttgattaatggaggaacaatatcaccatttttgttcaataagataccaaagtggatgattgactcattccatactagaaataatcgcaggaaatcttttgataacacggattcctttttctcaatgatatcccaggatcaagacaattggctgaatcccgtgaaaccattttatagaagttcattgatatcttctttttataaagcaaatcgacttcgattcttgaataatctacatcacttctggttctattgtaacaaaagattccctttttatgtggaaaaggcccgtatcaagaattatgattttacgtatggacaattcctcaatatcttgttcattcgcaacaaaatattttctttgtgcggcggtaaaaaaaaacatgcttttttggagagagatactatttcaccaatcgagtcacaggtatctaacatattcatacctaatgattttccacaaagtggtaacgaaaggtataacttgtacaaatctttccattttccaattcgatccgatccattcgttcatagagcgatttattcgatcgcagacatttctggaacacctctaacagagggacaaatagtcaattttgaaagaacttattgtcaacctctttcggatatgaatctatctgattcagaagggaagaacttgcatcagtatctcaatttcaattcaaacatgggtttgattcacactccatgttctgagaaatatttaccatccgaaaagaggaaaaagcggagtctttgtctaaagaaatgtgttgaaaaagggcagatgtatagaacctttcaacgagatagtgctttttcgactctctcaaaatggaatctattccaaacatatatgccatggttccttacgtcgacagggtacaaatttctaaatttgctatttttagataccttttcggacctattaccgatactaagtagcagtcaaaaatttgtatccatttttcatgatattatgcatggatcagatatatcatggcgaattcttcagaaaaaattgtgtcttccacaatggaatctgataagtgagatttcgagtaagtgtttacataatcttcttctgtccgaagaaatgattcatcgaaataatgagccaccattgatatcgacacatctgagatcgccaaatgttcgggagttcctctattcaatccttttccttcttcttgttgctggatatctcgttcgtacacatcttctctttgtttcccgagcctatagtgagttacagacagagttcgaaaaggtcaaatctttgatgattccatcatacatgattgagttgcgaaaacttctggataggtatcctacatctgaactgaattctttctggttaaagaatctctttctagtttctctggaacaattaggagattttctagaagaaatgcggggttctgcttctggcggcaacatgctatggggtggtggtcccgcttatggggttaaatcaatacgttctaagaagaaatttttgaatatcaatctcatcgatctcataagtatcataccaaatcccatcaatcgaatcactttttcgagaaatacgagacatctaagtcatacaagtaaagagatttattcattgataagaaaaagaaaaaacgtgaacggtgattggattgatgataaaatagaatccttggtcgcgaacagtgattcgattgatgataaagaaagagaattcttggttcagttctccaccttaacgacagaaaaaaggattgatcaaattctattgagtctgactcatagtgatcatttatcaaagaatgactctggttatcaagtgattgaagagccgggagcaatttatttacgatacttagttgacattcataaaaagtatctaatgaattatgagttcaatacaccctgtttagcagaaagacggatattccttgcttattatcagacaaccacttattcacaaacctcgtgtggggtgaatagttttcatttcccatctcatggaaaacccttttcgctccgcttagccctatccccctctaggggtattttagtgataggttctatagggactggacgatcctatttggtcaaatacctagcgacaaactcctatcttcctttcattacagtatttctgaacaagttcctggataacaagcctaagggttttcttattgatgatagtgacgatattgatgatagtgacgatattgatgtgagtgacgatatcgaccgtgactttgatacggagctggagtttctaactaggatgaatgcgctaactatggatatgatgccggaaatagaccgattttatatcacccttcaattcgaattagcaaaagcaatgtctccttgcataatatggattccaaacattcatgatctggatgtgaatgagtcgaattacttatccctcggtctattagtgaactatctctccagggattgtgaaagatgttccactagaaatattcttgttattgcttcgactcatattcccaaaaaagtggatcccgctctaatagctccgaataaattaaatacatgcattaagatacgaaggcttcttattccacaacaacgaaagcacttttttactctttcatatactaggggatttcacttgaaaaagaaaatgttccatactaatggattcgggtccataaccatgggttccaatgtacgagatcttgtagcacttaccaatgaggccctatcaattagtattacacagaagaaatcaattatagacactaatataattagatctgctcttcatagacaaacttgggatttgcgatcccaggtaagatcggttcaggatcatgggatccttttctatcagataggacgggctgttgcacaaaatgtatttctaagtaattgccccatagatcctatatctatctatatgaagaagaaatcttgtaacgaaggggattcttatttgtacaaatggtacttcgaacttggaacgagcatgaagaaattaacgatacttctttatcttttgagttgttctgccggatcggttgctcaagacctttggtctctacccggacccgatgaaaaaaatgggatcacttattatggacttgttgagaatgattctgatctagttcatggcctattagaagtagaaagcgctctggtgggatcctcacggacagaaaaagattgcagtcagtttgataatgatcgagtgacattgcttcttcggcccgaaccaagaagtcccttagatatgatgcaaaatggatcttgttctatccttgatcagagatttctctatgaaaaatacgaatcggagtttgaagaaggggaaggagaagaagtcctcgacccgcaacagatagaggaggatttattcaatcacatagtttgggctcctagaatatggcgcccttggggctttctatttgattgtatcgaaaggcccaatgaattgggatttccctattgggccaggtcatttcggggcaagcggatcatttataatgaagaggatgagcttcaagagaatgattcggagttcttgcagagtggagccatgcagtaccagatacgagatagatcctccaaagaacaaggcttttttcgaataagccaattcatttgggaccctgcagatccactctttttcctattcaaagatcagccccttgtctctgtgttttcacatcgagaattctttgcagatgaagagatgtcaaaggggcttcttacttcccaaacggatcctcctacatctatatataaatgctggtttatcaagaatacgcaagaaaagcacttcgaattgttgattcatcgccagagatggcttagaaccaatagttcattatctaatggatttttccgttcgaatactctatccgagagttatcagtatttatcaaatctgttcctatctaacggaacgctattggatcaaatgacaaaggcattgttgagaaaaagatggcttttcccggatgaaatgaaaattggattcatgtaataggagaaaggtttcccattccttagcctgaaagatatgtggccatgaaatagggattaagtggaacagaattgactgggtggtagagtcgtggaaacacctgtttcttccatattttggacatggaacaatatgttactgctgaaacatggaagaattgaaatcttagatcaaaacactatgtatggatggtatgaactgcctaaacaagaattcttgaacagcgagcaaccagaactattactcactacatcaaaaaatttccattaatgaaagatgtaaatccattgaaaaatcaaaaatacgtatgtcggatgaaatggtggttgttgctatctgctccaataacgaatcattggtttaactgaataactaaatgaataactaaataaaatagatagacccctctcttcgtctcaggtcgatggatcttctcaattggaggatcccctatatggataatacacattccagttgaccgggcctaattctaattgttttgttccgaagcaaagatatccacggggcggttcgtcctattcagatattcacgaccaagaagtactggattctctttcggataggcccggaaaggagaaggaaggccggaatgccaacagacgtctattattgaattcacccgacccgagagtacccattttattttgggaacatccagtgccaaagtcactgaatgggtaagtcgccaatccctaaaacggactatgtaat

SEQ ID NO: 9109 - DNA, 2505 bp, Papaver somniferum
ttgattcctcctaaattgcattgatttatcctaaagatttcatttcaattggaatttggttattcaccatgtacgaggatccccactaagcatccatggctgaatggttaaagcgcccaactcataattggcgaattcgtaggttcaattcctactggatgcacgccaatgggaccctccaataagtctattggaattggctctgtatcaatggaatcttctcatcatctatacataacgaattggtgtggtatattcatatcataacatatgaacagtaagaactagcattcttattgagactagaactcatagggaagaaaatcgatttatggatggaataaaatatgcagtatttacagacaaaagtattcggttattggggaaaaatcaatatacttttaatgtcgaatcaggatcaactaggacagaaataaagcattgggtcgaactcttctttggtgtcaaggtaatagctatgaatagtcatcgactcccgggaaagggtagaagaatgggacctatgggacatacaatgcattacaaacgtatgatcattacgcttcaaccgggttattctattccacctcttagaaagaaaagaacttaaaaaaaatacttaataacatggcgatacatttatacaaaacttctactccgagcacacgcaatggggccgtagacagtcaagtgaaatccaattcacgaaataatttgatctctggacagcgtcattgtggtaaaggtcgtaatgccagaggcatcattaccgcaaggcatagagggggaggtcataagcgtctataccgtaaaatagattttcgacgaaatgaaaaagacatatctggtagaatcgtaaccatagaatacgaccccaaccgaaatgcatacatttgtctcatacactatggggatggtgagaagagatatattttacatcccagaggggctataattggagataccattgtttctggtacagaagttcctatctcaatgggaaatgccctacctttgagtgcggtttgaaccattgatttacgtaattggaagtaaccaattaggtttacgacgaaacctagaaatcaatcactgatccaatttgagtacctctacgggatagacctcaacagaaaactgaagagtaacggcagcaagtgattgagttcagtagttcctcatataaaattattgactctagagatatggtaatatggagaagacaaaattgtttgaagcaccgacagaaccggaagcgccccttgtttcaaagagaggaggacgggttattcacatttcatttgatggtcagaggcgaattgaaagctaagcagtggtaattctacccccggggaaaaatagagatgtctcctacgttacccgtaatatgtggaagtatcgacgtaatttcatagagtcattcggtctgaatgctacatgaagaacataagccagatgatggaacggggagacctaggatgtagaagatcataacatgagtgattcggcagatttggattcctatatatccactcatgtggtacttcatcatacgattcatataagatccatctgtctagatatcattatatacatccagaaagccgtatgctttggaagaagcttgtacagtttgggaaggggttttgattgatcaaaaagaagaatctacttcaaccgatatgcccttaggcacggccatacataacatagaaatcacacttggaaagggtggacaattagctagagcagcaggtgctgtagcgaaactgattgcaaaagagggtaaatcggccacattaaaattaccgtctggggaggtccgtttgatatccaaaaactgctcagcaacagtcgggcaagtgggtaatgttggggtgaaccagaaaagtttgggtagagccggatctaagcgttggctaggtaagcgtcctgtagtaagaggggtagttatgaaccctgtagaccatccccatgggggtggtgaaggaagggccccaattggtagaaaacaacccacaaccccttggggttatcctgcgcttggaagaagaagtagaaaaaggaataaatatagtgatagtttgattcttcgtcgacgtactaaataggagataaaatcgagaatatgtttcttcgtctttacaaaagaaaaaaagataggagtaattagctgtgacacgttcactaaaaaaaaatccttttgttgctaatcatttattaggaaaaattgaaaagctcaacataagaggagaaaaagaaataatagtaacttggtcccgggcatctaccattatacccacaatgatcggccatacaattgctattcataatggaaaagaccatctgcctatttatataacagatcgtatggtgggtcacaaattgggagaatttgcacctactctaaatttccggggacatgcgagaagcgataataaatctcgtcgttaatgttaataataataaagtgaatatgggtgctcatcgttcattggtgggagg

SEQ ID NO: 9110 - DNA, 1440 bp, Cajanus cajan
gaactatttatttacgtaattggaagtaaccaactaggtttacggcgaaacctagaaatcgatcactgatccaattggagtacctctacaggatagacctcaacagaaaactgaagagtaacggcagcaagtgattgagttcagtagttcctcatataaaattattgactctagagatatagtaatatggagaagacgaaattgtttcaagcaccgacagaaccggaagcaccctttgtttcaaagaggggggcggattattcacatttcatttgatggtcagaggcgaattgaaagctaagctgtggtaattctaaggattccctggggaaaaatagagatgtctcctacgttacccgtaccgtgtggaagtagcgacgtaatttcatagagtcattcagtctgaatgctacatgaagaacataagccagatgaaggaacgggaagacctaggatgtagaagatcataacatgagtgattcggcagatttggattcctatatacccactcgtgcggtacttcattgtgcgatatagatatagatagatatatccatataagatccatctgtatagatatcatcatctacatccagaaagccgtatgctttgtaagaagcttgtacagtttgggaaggggttttgattgatcaaaaagaagaatctacttcaaccgatatgcccttaggtacggccatacataacatagaaatcacactcggaaagggtggacaattagctagagcagcaggtgctgtagcgaaactaattgcaaaagaggggaaatcagccacattaaaattaccttctggggaggtccgtttgatatccaaaaactgctcggcaacagtcggacaagtgggaaatgtgggggtaaaccagaaaaatttgggtagagccggatctaaatgttggctaggtaagcgtcctgtagtaagaggagtagttatgaaccctgtagaccatccgcatgggggtggtgaagggagggccccaattggtagaaaaaaacccgcaactccttggggttttcctgcacttgggaaaagaagtagaaaaaggaataaatatagtgataatttgattcttcgtcgtcgtagtaaatagtagagaaaattgaaattgtttcttcgtctttacaagaaaaaggagtaattaactgtgacacgttcactaaaaaaaaatccttatgtagcgaataatttattaagaaaaataaagaagcttaatacaaaagcagaaaaagaaataatagtaacttggtcccgagcatctaccattatacccacaatgattggacatacgattgctatccataatggaaaagagcatttacctatttatataacagatcgtatggtaggccataaattgggagaattttcacctactctaaacttccggggacatgcgaaaaatgataatagatctcgtcgttaa

SEQ ID NO: 9111 - DNA, 529 bp, Zea mays
gtcacgtggaaggggtgggcaattagctagagcagcaggtgctgtagcgaaactgattgcaaaagagggtaaattggccactttaagattaccatctggggaggtccgtttggtatcccaaaactgcttagcaacagtcggacaagtgggtaatgttggggtgaaccaaaaaagtttgggtagagccggatctaagtgttggctaggtaaacgccccgtagtaagaggggtagttatgaaccctgtggaccacccccatgggggtggtgaagggaaagcccccattggtagaaaaaaacccacaaccccttggggttatcctgcgcttggaagaagaactaggaaaaggaaaaaatatagtgatagttttattcttcgtcgccgtaagtaaatacgtaactaggaatatggaaaattgcatttttggaatttgcaataatgcgatgggcgaacgacgggaattgaacccgcgcatggtaaataatgcaaagcttcgccttttgactttaagagatacacataacaaaat

SEQ ID NO: 9112 - DNA, 1370 bp, Brachypodium distachyon
tattttagataatacaaaaaagaatagatataatagagtaggggcggatgtagccaagtggattaaggcagtggattgtgaattcaccatcgcgggttcaattcccgtcgttcgcccaggatgcccgggaccaagttattatgatttctttttccgcctttgtattaagcttctctatttttcttaataaatgctttgctacaaaagggtttttttttagtgaacgtgtcacagttaattaactcctattttttttaagacgaagaaagaaattagattttctctcctatttactacggcgacgaagaatcaaagtctcactatattttttcctttttctagttcttcttccaagtgcaggataaccccagggggttacgggtttttttctaccaattggagccctcccttcaccacctccatggggatggtcgacagggttcataactactcctcttactacaggacgtttacctagccaacgtttcgatccggctctacccaaacttttctggtttaccccaacatttcccacttgtccgactgttgctgagcagtttttggatatcaaacggacctctccagaaggtaattttaatgtggccgatttcccctcttttgcaatcagtttcgctacagcacccgctgctctagctaattgtccaccctttccaagtgtgatttcgatattatgtatggccgtgcctaagggcatatcggttgaagtagattcttctttttgatcaatcaaaaccccttcccaaactgtacaagcttcttccaaagcatacggctttctggatgtagatgatgatatctatacggatggatcttatatatatcgtagaattcttctatatatggtagaaataccacacgagtggatatataggaatcaaaatctgccgaataacttatgttatgatcttctacatcctaggtcttcccgttccgtcatctggcttatgttcttcatgtagcattcagaccgaatgactctatgaaattacgtcgatacttccacatattatgggtaacgtaggagacatctctatttttccccgggggaatctttagaattaccactgcttagctttcaattcgcctctgaccatcaaatgaaatgtgaataacccgtcctcctctctttgaaacaaggggcgcttatggttctgtcggtgcttgaaacaattttgtcttctccatattactatatctctagagtcaataattttatatgaggaactactgaactcaatcacttgctgccgttactcttcagttttctgttgaggtctatcctgtagaggtactcaaattggatcagtgatcgatttctaggtttcgtcgtaaacctaattggttacttc

SEQ ID NO: 9113 - DNA, 2027 bp, Ricinus communis
attgggtcgaactcttctttggtgtcaaggtaatagctatggatagccatcgactcccgagaaagggtagaagaatgagacctattatgggacatacaatgcattacagacgtatgatcattagtcttcaaccgggttattctattccacctcttagaaagaaaagaacttaaatcaaaatacttaatagcatggcgatacatttatacaaaacttctaccccgagcacacgcaatggagccatagacagtcaagtgaaatccaatacacgaaatacacgaaataatttgatctatggacagcatcattgtggtaaaggccgtaacgccagaggaatcattaccgcaaggcatagagggggaggtcataagcgtttataccgtaaaatcgattttcgacggaataaaaaagacatatatgggagaatcgtaaccatagaatacgaccctaattgaaatgcatacatttgtctcatacactatggggatggtgagaagagatatattttacatcctagaggggctataattagagataccattatttctggtacagaagttcctataaaaatgggaaatgccctacctttgagtgtggtttgaactattgatttacgaaattggaagtaactaattaggtttacgacgaaacttagaaatcgatcactgatccaaattgagtacctctacaggataaacctcaacagaaaactaaagagtaacggcagcaagtgattgagttcagtagtttctcatagaaaattattgactctagagatatagtaatatggagaagacaaaattatttcaagtaccgacagaaccggaagcaccccttgtttcaaagagaggaggacgggttattcacattttatttgatggtcagaggcgaattgaaagctaagcagtggtaattctaaagattccccggggaaaaaatagaaatgtctcctacgttacccctaatatgtggaagtatcgacgtaatttcatagagtcattcgatctgaatgctacatgaagaacataagccaaatgaaggaacgggaagacctaggatgtagaagagcataacatgagcgatttaacagattttaattcctatatatccactcatgtagtactttttttcattttacgatatataagatccatctgtataaatatcatcatctacacccagaaagccgtatgctttggaagaagcttgtacagtttgggaagaggttttgattgattaaaaagaagaatctacttcaaccgatatgcccttaagcacggccatacataacatagaaatcacatttgaaaagggtggacaattagctagagctgcaagtgctgtagcgaaactgattgcaaaagaggagaaatcggccacattaaaattaccttctcgggaggttcgtttaatatccaaaaactgctcagcaacagtcggacaagtagggaatactggggtgaaccagaaaagtttgggtagagccagatctaaatgttgactaggtaagcgtcctgtagtaagaggagtagttatgaaccctgtagaccatccccatgggggtggtgaagggagggccccaattggtagaaaaaaaacccgcaaccccttggggttatcctgcacttggaagaagaagtagaaaaaggaataaatatagtgataatttgattcttcgtcgccgtagtaaatagaagaaaaaatagaatttgtttattcgtcttttcaaaataaataaaaaaataggagaaattcactgacacgttcactaaaaaaaatccttttgtagcaaatcatttattaaaaaaaataaataagcttaacacaaaaacagaaaaagaaataatagtaacgtggttccggacatctaccattatacccacagtgatcggccatactattgctatccataatggaaatgagcatttacctatttatataacagatcgtatggtgggccataaattaggagaatttgcatctactctaaatttcggggacatgcaaaaaatgataataaatctcgt

SEQ ID NO: 9114 - DNA, 609 bp, Ceratodon purpureus
ttacaacgattgaatatgatcctaatcgtagtgcaaatatatgtcttgtacaatatgaagatggagaaaaaggtatattttacatccgcgcggaataaaaattggggatacaattatttctagtaatgaagctcctattttaataggaaacgccttacctttgaccaatatgcctttaggcactgctatacataatatagaaataacacctggtaaaggggcccaattagtaagaactgccggagctgtagccaaactcattgcaaaagaaggctatttagctactttacgattaccttctggtgaagttcgtttagtatctcaaaattctttagcgaccattggacaaattggaaatgttgatgctaacaataaaagtattggtaaagctggatctaaaagatggctaggaaagcgtcctaaagtaagaggtgttgttatgaatcctatagatcatccacatggaggtggcgaaggccgggctcctattggaagaaaaaaaccattaactccgtggggtcgtactgcacttggaaaaagaactcgaaaaattaaaaatatagtgatcctttaattttgcgtcgccgtaaaaatggataatagaatttg

SEQ ID NO: 9115 - DNA, 1280 bp, Tripterygium wilfordii
ttttgattgatcaaaaagaagaatctacttcaaccgatatgcccttaggcacggccatacataacatagaaatcacacttggaaagggtggacaattagctagagcagcaggtgctgtagcgaaactgattgcaaaagaggggaaatcggccacattaaaattaccttctggggaggtccgtttgatatccaaaaactgctcagcaacagtcggacaagtagggaatgttggagtgaaccagaaaagtttgggtaaagccggatctaaatgttggctgggtaagcgtcctatagtaagaggagtagttatgaaccctgtagaccatccccatgggggtggtgaagggagggcccaaattggtagaaaaaaacccgtaaaccccctcgggttatcctgcacttggaagaagaagtagaaaaaggaataaatatagcgataatttgattcttcgtcgccgtagtaaataggagagaaaatagaatttgtttcttcatctttacaaaaaaaaataggagtaattaactgtggcacgttcactaaaaaaaaatccttttgtagcgaatcatttattaggaaaaataaataagcttaacacaaaggcggaaaaagaaataatagtaacttggtcccgggcatccaccattatacccacaatgatcggacataccattgctatccacaatggaaaggaacatttgcctctttatataacagatcggatggtaggacataaattgggagaatttgcacctactctcaatttccggggacatgcaaaaaatgataatagatctcgtcgttaataaaaaagaatcaaaaaaaaagaaatgggcgaacgataactaataaatagttcattaaaaagaggtggactttatgataaaaaaaaaaatatatatacaccatatacaaaagtatacgcaataggtcagcatatgtctatgtctgctcacaaagcgaaaatagtaattgatcagattcgcggacatttttacgaggaaacacttaggatactcgaactcatgccttttgaaatatgttatcccgtttttaaattggtttattctgcagcagcaaatgcaagtcacaatattgagtccaacaaatcaaacttaatcattagcaaagctgaagtcaacgagggcggaactctgaaaaaatttaaacctcgagctcgaggacgaagttatccgataaaacgacgcacttgtcatataactattgtattgaaagatatatctttaaatgaatatgaagaattataaaaactataacgata

SEQ ID NO: 9116 - DNA, 5135 bp, Phaseolus coccineus
attgaatcgattcaatacatttcttatgtaaacatgggtgctatattggatttgaatcagatttcggatcaatctatattgattgactgcctccattatgttgttgctagcaaatacaactattttaggttttggatcttccaaattattcccgcaagaggtctggacccatttttttatgatccttcgataaaaagattcattctgttcataaaaaagaggaggtagaaccaataaagagtgctttttcgattcatccctggagttcaataactcattcaagaaatgtttttgatccaatccggaggaatcaatagaaaaatcaaattccttatgatacaccagatccggctcggttattgatagagtgaatagatctgccatttcttgaaatagatcttctgattcaaaatcgtggtgtaacgtgtatctccccctgttccggtcatggaatagatgaaagaaaccccaaaatggatttttgttcaagaatgaaatcttattggaactgtccaattcatcctttggaaccatatcacatcctcgataggatgaaataggatgaattgagacggtattttgtaagtacataattatcttgaataaattcactatttctttcttttccgatcgcctggaaagagcaagatgtttcttttgttcttttttcaacaatttctgatctctagtagacctatcagtaggattcgaacccagatgaagttctgaccatctgtcagagaaaaaagaacgagtggctcttgcaggattcccaagaaattcttcgatttcttccggaagcagatgattattcatctgcttctcacgttccatgaatagtcggcacattgaggaatatccagaaaggtttttaaggaatcgctctgattctatctctgttcgttccgtttgaagaaaggaaggatcccaacaaagaatcgatctttcttttagttgttgaatctctctttgattgatcaatgtgtgatatttcgaatcctcattcctaatggaatcgaaagaatccttggattgatcagaagatcctttcaattggctagaatccgttacttgaatgaaactagatctcgtggaatcatattgaagatttgatgatacattccgtaccttgctaaaaaaccgatccttgtttcccaaccacacattgtctaaccaaatccaattctcttgtgacatgttcctcaaaaaatccgattcgtgcggactcttcccccaactaacgaagagatcttgacggaattgccacatatgaaattgagcacaattttgcaaagaaatagcccgcttgtttctcaagaagagatgcgaaacatgctcaatatcatttgattgaataattgacccagtcccttgttgtttgaagaaaccctccacttcctttggtattttttcacgaaaagcaaacatgagataataaatccagtctttcactaagatttcgaatagctgtcccgaattcaagttgattatgtttcgcctctttctcggggaaagacgatcaaaaaattcccaatcatggtccttacggatcggatcatccatataatatacaaaaaggaactccagatatttgatatctttctctttgaatgagatctcaattccagcgatggtttcattagatatcttacaactagaatagctcttttttcctatccagttcctccaccaccgcgaaccccagttaaattcaggcatgatatactttttagttattgggagaacccgagtactctctttcggatccaggaaagaactctcagagatcttttttccttttggaagatacaggagcggaacaatcaacctattgatattggaagactcagatgattcttccaatgtatcatttttgggtccaatggaattcataggtataggaagaagccttgtcaaatagggattttttctttcgaccatttttcgattgttaatacgatatataaggaccgctactacaaagagtactacatacttgatcgtgaaatatcgattgcttgttgaaccctgtgaattgcgtgaaagtaggatactccaaattcgggagtccaagagttttataaaactctcttgatggaaaaaaatatgaatgagaaatcccgctgaattgaattgggtccatgaatctaagaaatagcgagaattcttgatttctttcaatatctctctcaattcgaaaatccaggatttgaattgatgtcctttcatcgaatcctcctaattgcattgatttatccgaaagatttcacttcaattggaatttggttattcaccatgtacgaggattcccgctaagcatccatggctgaatggttaaagcgcccaactcataattggcgaattcgtaggttcaattcctactggatgcacgccaatgggaccctccctccaaaaagtctatcggatttttgttcaagaatgaaatcttattggaactgtccaattcatcctttggaaccatatcacatcctcgataggatgaaataggatgaattgagacggtattttgtaagtacataattatcttgaataaattcactatttctttcttttccgatcgcctggaaagagcaagatgtttcttttgttcttttttcaacaatttctgatctctagtagacctatcagtaggattcgaacccagatgaagttctgaccatctgtcagagaaaaaagaacgagtggctctgtatcaatggaatctcatcatccatacataacgaattgatgtggtatattcaaatcataacatatgaacagtaaaaactagtattttaattgagactagaactcatagggaagaaaatatatttatgaatggaataaaatatgcagtatttacagacaaaagtattcggttattggggaaaaatcaatatacttttaatgtcgaatcgggatcaactaggacagaaataaagcattgggtcgaactcttctttgatgtcaaagtaatagctatgaatagtcatcgactcccggtaaagggtagaagagtacgacctattatgggacatacaatgcattacagacgtataatcattacgcttcaaccgggttattctattccacctcttagaaagaaaagaacttaaatcaaaatacttaatagcatggcgatacatttatacaaaacttctaccccaagcacacgcaatggagccgtagacagtcaagtaaaatccaatccacgaaatcatttgatctatggacagcatcgttgtggtaaaggccgtaatgccagaggaataattaccgcagggcatagagggggaggtcataagcgtctataccgtcaaattgattttcgacggaatgaaaaaaacatatatggtagaatcgtaaccatagaatatgaccctaatcgaaatgcatccatttgtctcatacactatggggatggtgagaaaaaatatattttacaccccagaggggctataattggagataccattgtttctggtacagaagttcctataaaaatgggaaatgccctacctttgagtgcggtttgaactattgatttacgtaattggaagtaaccaactaggtttacggcgaaacctagaaatcgatcactgatccaattggagtacctctacaggatagacctcaacagaaaactgaagagtaacggcagcaagtgattgagttcagtagttcctcatataaaattattgactctcgagatatagtaatatggagaagacaaaattgtttcaagcaccgacagaaccggaagcaccctttgtttcaaacaggggagggcgggttattcacatttcatttgatggtcagaggcgaattgaaagctaagctgtggtaattctaaggattccccctgggaaaaagagagatgtctcctacgttacccgtaccatgtggaagtagcgacgtaatttcatagagtcattcagtctgaatgctacatgaagaacataagccagatgaaggaacgggaagacctaggatgtagaagatcataacatgagcggcagatttggattcctatatacccactcgtgcggtacttcattgtgcgatatatagaagatccatctgtatagatatcatcatctacatccagaaagccgtatgctttgtaagaagcttgtacagtttgggaagaggtttttattgatcaaaaagaagaatctacttcaaccgatatgcccttaggcacggccatacataacatagaaatcacactcggaaagggtggacaattagctagagcagctggtgctgtagcgaaactaattgcaaaagaggggaaatcggccacattaaaattaccttctggggaggtccgtttgatatccaaaaactgctcggcaacagttggacaagtgggaaatgttggggtaaaccagaaaaatttaggtagagccggatctaaatgttggctaggtaaacgtcctatagtaagaggagtagttatgaaccctgtagaccatccgcatgggggtggtgaagggagggccccaattggtagaaaaaaacccgcaactccttggggttttcctgcacttggaagaagaagtagaaaaaggaagaaatatagtgataatttgattcttcgtcgtcgtactaaatagtagagaaaatagaaattgtttcttcgtctttacaagaaaaaggagtaattaactgtgacgcgttcactaaaaaaaaatccttttgtagcgaatcatttattaagaaaaataaataagcttaacacaaaagcggaaaaagatataatattaacttggtccagagcatctaccattatacctacaatgattggccataccattgctatccataatggaaaagaacatttacctatttatataacagatcgtatggtaggccataaattaggagaattttcacctactctaaacttccgaggacatgcgaaaaatgataatagatctcgtcgttaacgttcattttcacatccattttgaaagaggaatgcataaatccataaatattacaaaattgaattattaggaaaatgaagttcaactcatttcttttagaattcatgaaattcatgaaataatgaataataataaaattcttttttcattcagaattcaatcaattcaataaaatattcaatt

SEQ ID NO: 9117 - DNA, 4291 bp, Ricinus communis
taaatgataaatcaaacaaggaaggatcctttttttgatatataggaatagctgggacggaaggattcgaacctccgaatagcgggaccaaaacccgttgccttaccacttggccacgccccatttgaatttttattcaacactaataaaaactaatattggtattagctcttcgtcaattcccaccaaatatctagaaaatatattagcttgttgttcggatttttctatgtgtagatatagaattaaattcaatttattgatcataatatataattcaattaagatactgtataaaaatatgatttcctctattcttttttgatttgagaattgaaggatttttgattgggtgagtttaataaatttaataaagtttaataaagaagggtttttaatctacctttctttatctttattttttatcaatttttatatcttttcttttatattaataacatattaataactcagtcaaaataaaattatctttaagaacaaaatgtttgttatgcttaatatttttagtttaatttgtatctgtcttaattctgtcctttattcaagcaattttttcttcacaaaattgcccgaagcctacgcctttttgaatccaatcgtagatgttatgccagtaatccctgtactcttttttctattagcctttgtttggcaggctgctgtaagttttcgatgagatctttaatgctgtcctaaaataattcatgatttattcgagaaaaaaaattatagcaattgataagatcagataagtcttatagtataaagcgaacagtgattcgattgatgagatttggtatgatacttatgagatcgatgagattgatattcaaaaatttattcttagaacgtattgatttaaccccataagcgggaccaccaccccatagcttgttgccgccagaagcagaaccccgcatttcttctagaaaatctcctaattgtttcaaagaaactagaaagagattctttaaccagaaagaattcagttcggatgtaggatacctatccagaagttttcgcaactcaatcatgtatgatggaatcatcaaagatttgaccttttcgaactctgtctgtaactcactataggctcgggaaacaaagagaagatgtgtacgaacgagatatccagcaacaagaagaaggaaaaggattgaatagaggaactcccgaacatttggcaatctcagatgtgtcgatatcaatggtggctcattatttcgatgaatcatttcttcggacagaagaagattatgtaaacacttactcgaaatctcacttatcagattccattgtggaagacacaattttttctgaagaattcgccatgatatatctgatccatgcataatatcatgaaaaatggatacaaatttttgactactacttagtatcggtaataggtccgaaaaggtatctaaaaatagcaaatttagaaatttgtaccctgtcgacgtaaggaaccatggcatatatgtttggaatagattccattttgagagagtcgaaaaagcactatctcgttgaaaggttctatacatctgccctttttcaacacatttctttagacaaagactccgctttttcctcttttcggatggtaaatatttctcagaacatggagtgtgaatcaaacccatgtttgaattgaaaccctattctttaattgtccggctataaattctgcaagaatattagggtgcccataagggtttgaaattcttgtaatagcaatattgagttttcggttcacacaatttagttctttttgtacatttatctgtaatttctcgattcgtttaggtttactttctattaataattttgtgaatcccatatatattattactttaatcatatcaattcttttctgaatctctatacatgcaattccctcaacaccagaagatatttttgtattgttttttacataattcttgatacaatttcttattttttgatcttcttgtagaccctcaaagtaattttttggttgagcaaaccaaagagaataatgactttgggttgtaccaagttggaaaccaagtggatttattttttgtcccataatcccccactacttactatacatatcatgaaatgtcgcatctgtggatttcattttttttatccacccccggttttttaagcatatgttatattcttcatattcttcatataaagatatattctttaatacaatagttatatgacaggtcgatctttttatcagataaccccgccctcgagcttcaggttttaattttttcacagtagcaccttcgttgacttcggctttactaatgattaaattggcttcgttgaaacccatattgtggcgagcgtttgctactgcagaataaattaattttaaaatgggataacatgctcgataaggcataagctcgagtatcataagtgtttcttcataagaacgtccacgaatctgatcaattattcttcgtgctttgtgagtggacatacatagatgttggcctaaagcatatacttccgtatatggatctctctttttctttcttttatttatcataagatttattaacctctttttttttaatgtcataaataaagtaataattttattgaacgagaaaagtcagaaaaaaatttaaattgtaaaatgaaactaataaatatacatatctttaattctaaattactattactctaaatctaaattacaaaatactattcactattcaaatatctatattttccttttcaatttaaatgaaacttttaaaatgaaagaaaattttcaattaaattgaaattttctttttttatttttttatttatatttaatattaattttattaattttatttaatattaatttcaatctttttttatttaataatattaatattcattttttatttaatatttaaatatttatttaaatttaaaatgaaatattcattttattaattttaaatattaattatttaggaattaagattaacgaattaacgacgagatttattatcattttttgcatgtccctggaaatttagagtaggtacaaattctcccaatttatggcccaccatacgatctgttatataaataggtaaatgctcctttccattatggatagcaatactatggccgatcattgtgggtataatggtagatgcccgggaccacgttactattatttctttttctgcttttgtgttaagcttatttatttttttaataaatgatttgctacaaaaggattttttttttttagtgaacgtgtcatagtgaatttctcctatttttttttattttgaaaagacgaagaaacaaattctattttttctcctatttactacggcgacgaagaatcaaattatcactatatttattcctttttctacttcttcttccaagtgcaggataaccccaaggggttgcggatttttttctaccaattggggccctcccttcaccacccccatggggatggtctatagggttcataactactcctcttactacaggacgcttacctagccaacatttagatccggctctacccaaacttttctggttcaccccagtattccctacttgtccgactgttgctgagcagtttttggatattaaacgaacctccccagaaggtaattttaatgtggccgatttctcttcttttgcaatcagttttgctacagcacctgcagctctagctaattgtccaccctttccaaatgtgatttctatgttatgtatggccgtgcctaagggcatatcggttgaagtagattcttctttttgatcaatcaaaacctcttcccaactgtacaagcttcttccaaagcatacaactttctgggtgtagatgatgatatctatacagatgaatcttatatatcgtaaaatgaaaaaagtactatatgagtggatatataggaatcaaaatctgctaaatcgctcatgttatgctcttctacatcctaggtcttcccgttccttcatctggcttatgttcttcatgtagcattcagaccgaatgactctatgaaattacatcgatacttccacatattaggggtaacgtaggagacatttctattttttccccggggaatctttagaattaccattgcttagctttcaattcgcctctgaccatcaaatgaaatgtgaataacccgtcctcctctctttgaaacaaggggtgtttccggttctgtcagtgcatgaaacaattttatcttctccatattactatatctctagagttaataatttt

SEQ ID NO: 9118 - DNA, 17779 bp, Gossypium raimondii
atttcatagtaatagaaatacatgtcctaccgaaacagaatttgtaacttgctatcctcttgcctagcgggcaaggatttacctccgtggaaaagatgattcattcggatccgcatgaaagcccaactccattgcattgccagaatccatgttgtatatttgaaagaggttgacctccttgcttctctcatggtacaatcctcttcccgctgagccccctttctcctcggtccacagagacaaaatggaatgtaggactaggactggcgccaacagttaatcacggaagaaaggactcactgagccgggatcactaactaatactaatctaatctaactaatactaatctaatactaatagaatagaatactaatctaatactctaatactaatagaatagaaaaaatagaatagaaaatactaatataatagaaagaaaagaactgtcttttctgtatactttccccggttccgttgctaccgcgggctttacgcaatcgatcggatcatatagatatcccttcaacacaacataggtcgtcgaaaggatctcggagactcaccaaagcacgaaagccaggatctttcagaaaatggattcctattcgaagagtgcataaccgcatggataagctcacactaacccgtcaattttggatccaattcgggattttccttggggggtatcagtaaggaattggaatgtaataatattgattcatataggaggaaaaggttctctattgattcaaatgctgtacctatgggatagggatagagaaagaggaaaaaccgaagatttcacatagtgcttttgatcgaaaaatcaatctgatttatttcgtacccctcgctcaatgagaaaatgggtcagattctataggatcaaacctatgggacttagggaatgatggaagggaataaaataaaaaaaaaagaaatcaaaaaaagaggggaaaaaaataatcaaaataataaataagtaaataaaaatgaagtagaagaacccagattccaaatgaacaaattcaaacttgaaaaggatctttctgattctcgaagaatgaggggcaaagggattgatcgagaaagatctcttgttcttattataagatcgtgtgattggatccgcagatgtttggtaaaaaaaatcttctcttttgagaataatcaaaaatggaaagtgttcaattggaacatgaaaacgtgactgaatttgtcctagttactcttcgggacagagtggaagaagggaggagattctcgaacgaggaaaaggacccaatgacttcgaaagaattgaacgaggagccgtatgaggtgaaaatctcatgtacggttctgtagagtggcagtaagggtgacttatctgtcaacttttccactatcacccccaaaaaaccaaactctgccttacgtaaagttgccagagtacgattaacctctgggtttgaaatcactgcttatatacctggtattggccataattcacaagaacattctgtagtcttagtaagagggggaagggttaaggatttacccggtgtgagatatcacattgttcgaggaaccctagatgctgtcggagtaaaggatcgtcaacaagggcgttctagtgcgttgtagattcttatccaagacttgtatcatttgatgatgccatgtgaatcgctagaaacatgtgaagtgtatggctaacccaataacgaaagtttcgtaaggggactggagcaggctaccatgagacaaaagatcttctttctaaagagattcgattcggaactattatatgtccaaggtccaatattgaaataatttcagaggttttccctgactttgtccgtgtcaacaaacaattcgaaatgcctcgactcttttagaacaggtccgggtcaaatagcaatgattcgaagcacttctttttacactatttcggaaacccaaggactcaatcgtatggatatgtaaaatacaggatttccaatcctagcaggaaagggagggaaacggatactcaatttaaagtgagtaaacagaattccatactcgatctcatagatacatatggaattctgtggaaaaccgtattcgatgaaagtcgtatgtacggcttggagggagatctttcatatctttcgagatccaccctacaatatggggtcaaaaagccaaaataaatgattttagcccttataaaaagaaaatggattcttgaacccctttcacgctcatgtcacgtcgaggtactgcagaagaaaaaactgcaaaatccgatccaatttatcgtaatcgattagttaacatgttggttaaccgtattctgaaacacggaaaaaaatcattggcttatcaaattatctatcgagccttgaaaaagattcaacaaaagacagaaacaaatccactatctgttttacgtcaagcaatacgtggagtaactcccgatatagcagtaaaagcaagacgtgtaggcggatcgactcatcaagttcccattgaaataggatccacacaaggaaaagcacttgccattcgttggttattaggggcatcccgaaaacgtccgggtcgaaatatggctttcaaattaagttccgaattagtggatgctgccaaagggagtggcgatgccatacgcaaaaaggaagagactcatagaatggcagaggcaaatagagcttttgcacattttcgttaatccatgaacaggatcgatatagacacatagattcatggatccatacatctcgatcggaaaagaatcaatagaaaaagaaagaatcggaattgatcgatatatttctcgaaacaaacgaaaaggaaacgaaagctgaaacataaatcatggatcaactaagccctctcggggacttgcttaagaataagaaagaggaatctcatgtaaataccatggaataaggtttgatcctattcatggggattccgtaaatattcccattccaaaactagaaagttcgaaacaattgggattttttttggagattggatgcagttactaattcatgatctggcatgtacagaatgaaaacttcattctcgattctacgagaatttttatgaaagcctttcatttgcttctcttcgatggaagttttattttcccagaatgtatcctaatttttggcctaattcttcttctgatgatcgattcaacctctgatcaaaaagatataccttggttatatttcatctcttcaacaagtttagtaatgagcataacggccctattgttccgatggagagaagaacctatgattagcttttcaggaaatttccaaacgaacaatttcaacgaaatctttcaatttcttattttactatgttcaactctatgtattcctctatccgtagagtacattgaatgtacagaaatggctatagcagagtttctgttattcgtattaacagctactctaggaggaatgtttttatgcggtgctaacgatttaataactatctttgtagctccagaatgtttcagtttatgctcctacctattatctggatataccaagaaagatgtacggtctaatgaggctactacgaaatatttactcatgggtggggcaagctcttctattctggttcatggtttctcttggctatatggttcatccgggggagagatcgagcttcaagaaatagtgaatggtcttatcaatacacaaatgtataactccccaggaatttcaattgcgcttatattcatcactgtaggaattgggttcaagctttccccagccccttctcatcaatggactcctgacgtatacgaaggagtgcggttcgttcgataaattcctacctctctatctatctctgagatgtttggatttttcaaaactccatggacatgcagaagagaaatgctatccccactcagaccaagacataactttgactttgacttgttcaaataacaattaaggtgaagcagggtcaggaacaacgattctctttatgataaacagatccattttgcaagttcgttattacgggtagttcctacaaaggatcggactaatgacgtatacaatacttgaattctcgatgtagatgctacatagttggttctcatccttcagagactacgagtgtaataggagcatccgtcgacaaaaggatcaccctaagatgatcatctcatggctattgagaacgaatcaaatcagatggttctatttctcaatctttctgacttgctcctacggaaccaaggtcgaaaagattgagaaaaatcagtcattcacaaccactgatgaaggattcctcgaaaagttaaggattagtaatccgttttagaaatcgaatgggttcgatcttatacatacgcgaggaaggtaatcaaaaaaaagaaagaagataagttcttctttacttttatcacttaggagccgtgcgagatgaaagtctcatgcacggttttgaatgagagaaagaagtgaggaatcctcttttcgactctgactctcccactccagtcgttgcttttctttctgttacttcgaaagtagctgcttcggcttcagccactcgaattttcgatattcctttttatttctcatcaaacgaatggcatcttcttctggaaatcctagctattcttagcatgatattggggaatctcattgctattactcaaacaagcatgaaacgtatgcttgcatattcgtccataggtcaaatcggatatgtaattattggaataattgttggagactcaaatggtggatatgcgagcatgataacttatatgctgttctatatctccatgaatctaggaacttttgcttgcattgtattatttggtctacgtaccggaactgataacattcgagattatgcaggattatacacaaaagatccttttttggctctctctttagctctatgtctcttatctctaggaggtcttcctccactagcaggttttttcggaaaactccatttattctggtgtggatggcaggcaggcctctatttcttggtttcaataggactccttacgagcgttgtttctatctactattatctaaaaataatcaagttattaatgactggacgaaaccaagaaataacccctcacgtgcgaaattatagaagatcccctttaagatcaaccaattccatcgaattgagtatgattgtatgtgtgatagcatctactataccaggaatatcaatgaacccgattattgcaattgctcaggatacccttttttagtttagcttctagttagcttctagaatctatttcttagttcaaggtccctctttactaactggaatcaaagaattagtagatctgttccgcccaaaatgggaatgggctggggttatgaacttataatctataatctgatgatcgagtcgattccatgattataagttcattccataccggaccagaccggaatagggctatatacattctcattatgagaaggggtcattcgagcgtatctaaatagatactatgtttacatatggatccctacgtcgttacattccatttaggattaggaatgggcgtaatcgggccttctttttacatatctctcgttatttgggaccctattcacctcttttcttttttcttctattgaatcgagaaataaataggtttgattgtccatctttttaatctaatctatatatatttaatataatcttaatatagacatcctccggatacttcaaatcgaagcaattggatgtccgactcgggcctatatgacatgaccgatcaatagaaatactccaacactccacctttgtcatatattccatacatcacactagatagatatcatattcatggaatacgattcacttgcaagatgccttggtggtgaaatggtagacacgcgagactcaaaatctcgtgctaaagagcgtggaggttcgagtcctcttcaaggcataatattgagaatgctcattgaattggaataagttcggcagcggatcacgagatcttggtgatcttctctatctaatgaatggggagtccgctttgaaatcgttcgccctgcacccacccccgagtatatgcttcaacaggaatcacgcacacaagggtagattgatacaatataaacctctggtaaaatgccccccccgtaacccagcggataaagtacattacatagtccgttttagggattggcgacttacccattccgtgactttggcactggacgttccaaaaatgggtactatcgggtcgggtgaattcaataatagacgcctggtggcattccagctttccttctcctttcaggacctatccgaaagagaatccagtacttctcggtcgtgaatatctgaatagggcgaaccgccccgtggatatcttttcttcggaacaaaacaattagaatagaattaggctcggtcaactggaatgtgtattatccatatattatccatataggggatcctccagttgagaagatccatcgacctgagacgaagagaaaggtctatctattttatttagttattcagttaaaccaatgattcgttattggagcagatagcaacaaccatttcatccgacatgcgtatttttgattttccaatggatttacatctttcattaatggaaattttttgatgtagtgagtaatagctctggttgttcgctgttcaagaattcttgtttaggcagttcataccatccatacatagtgttttgatctaagatttcaattcttccatgtttcagcagtagcatattgtttcatggagctaaggtccaaaatatggaagaaacaggtgtttccacaactctaccacccagtccgttccacttaatccctatttcatgaccacatatctttccggctaagtaatgggaaacctttctcctcttacatgaatccaattttcatttcatccgggaaaagccatctttttctcaacaatgtctttgtcatttgatccaatagccttccgttagataggaacagatttgataaatactgataactctcggatggagtattagaacggaaaaatccattagataatgaactattggttctaagccatctctggcgatgaatcaataattcgaagtgcttttcttgcgtattcttgataaaccagcgtttatatatagatgtaggaggatctgtttgggaagtaagaagcccctttgacatctcttcatctgcaaagaattctcggtgtgaaaacacagagacaaagggctgatctttgaataggaaaaagagtggatccgcaggatcccaaatgaattggcttattcgaaaaaagccttgttctttggaagatctatctcgtgcctggtactgcatggttccactctgcaagaacgccgaatcattctcttgaagctcatccttttcatcataaatgatccgcttgccccgaaatgacccggcccaatagggaaatcccaattcatttggcctttcgatacaatcaaatagaaagccccaagggcgccatatcctaggagcccaaactatgtgattgaataaatcctcctctatctgttgcgggtcgagtactccttctccttccccttcttcaaactccgattcgtatttttcatagagatttctctgatcaacgatagaacaagatccattttgcatcatatataagggattccccggctcggaccgaagaagcaatgtcactcgatcattatcaaactgaccgcaatctttttctgtccgtgaggatcccaccagagcgccttctacttctaataggccatgaactagatcagaatcattctcaacgaacccataagaagtgatcccatttttttcatcgggtccgggtagagaccaaaggtcttgagcgaccgatccggcagaacaactcaaaagataaagaagtatcgttaatttcttcatgctcgttccaagctcgaagtaccatttgtacaaataagaatccccttcgttacatgatttcttcttcatatagatagatataggatctaaggggcaattacttagaagtacattttgtacaacagcccttcctatctgatagaaaaggatcccatgatcctgaaccgatcttacctgggatcgcaaatcccaagtttgtctatgaagagcagatctaattgtattagtgtctataattgatttcttctgtgtaatactaatcgatagggcctcattggtaagtgctacaagatctcgtgcattggaacccacggttatggacccgaatccattagtatggaacattttcttttccaagtgaaatcccctagtatatgaaagagtgaaaaagtgctttcgttgttgtggaataagaagccttcgtatcttaatacatgtatttaatttattcggggctattagagtgggatccactttttggggaatatgagtcgaagcaataacaagaatatttctagtggaacatctttcacaatccttggagagatagttcactaatagaccgagggataagtaattcgcctcattcacatccagatcatgaatgtttggaatccatattatgcaaggagacattgcttttgctagttcgaattgaagggtgatataaaatcggtctatttccgacatcatatccatagttaacgcattcatcatagttagaagctccagctccgtatcaaggtcacgatcaatagcgtcactatcatcaatagcgtcactatcatcaataagaaaacctttaagcttgttatccaggaacttgttcagaaatactgtaatgaaaggaacataggagtttgtcgctaggtatttgaacaaataggatcgtccggttcctatagaacctatcactaaaatacccctagagggagatagggctaagcggagcgaaaagggttttccacgagacgggaaatgaaaactattagccccacacgaagtttgtgaataagtgattgtctgataatgagcaaggaatatccgcctttctgctaaacaggatgtattgaactcataattcattagatactttttatgaatgtcaactaagtatcgtaagtaaattggtcccggttgttcaatcatttgataaccagagtcattctttgataaatgatcactatgagtcagactcaatagaatttgatcaatccttttttctgtcgttaaggtggagaactgaaccaagaattctctttctttatcatcaatcgaatcactgttcgcgacccaggattctattttctcatcaatccaatcaccgctcacgttttttctttttcttatcaatgaatagatctctttacttgtatgacttagatgtctcgtatttctcgaaaaaatgattcgattgatgggatttggtatgatacttatgagatcgatgatatcgatgagattgatattcaaatatttcttcttagaacgtattgatttgaccccataagcgggaccaccaccccatagcatgttgccgccaaaagcagaaccccgtatttcttctagagaatctcctaattgttccagagcaactagaaagagattctttaaccagaaagaattcagttcagatgtaggatacctatccagaagttttcgcaactcaatcatgtatgatggaatcatcaaagatttgaccttttcgaactctgtctgtaactcactataggctcgggaaacaaagagaagatgtgtacgaacgagatatccagcaacaagaagaaggaaaaggattgaatagaggaactcctgaacatttggcgatctcagatgtgtcgatatcaatggtgactcattatttcgatgaatcatttcttcggacagaagaaaattatgtaaacacttactcgaaatctcacttatcagattccattgtggaagacacaattttttctgaagaattcgccatgatatatctgatccatgcataatatcatgaaaaatggatacacatttttgactgctacttagtatcggcaataggtctgaaaaagtatctaaaaatatcaaatttagatatttgtaccctgtcgaagtaaggaaccatggcatatatgtttggaatagattccgttttgagagagttgaaaaagcactatctcgttgaaaggttctatacatccaccctttctcaacgcatttctttagacaaagactccgttttttccgcttttcggatggtaaatatttctcagaacatggagtgtgaatcaaacccatgtttgaattgaaattgagatactgatgcaagttcttctcttctgaatcagatggattcatatctgaaagaggttgacaataagttctttcaaaattgactatttgtccctctgttagaggtgttccagaaatgtctgcaatcgagtaaatagctctacgaactaatggatcggatcgaattgcaaactggaaagatttgtacaagttatacctttcgtcaccactttgtggaaaatcattagatatgaatatgttagatacctgcgactcgattggtgaaggtgaaatagtatctctccccaaaaaagcatgtttttttttaccaccgcacaaagaaaatattttgttgcgaatgaacaagatattgaggaattgtccatacgtaaaatcataattattgatacgggccttttccacataaaaagggaatcttttgttacaatagaagcagaagtgatgtggattattcaagaatcgaagtcgatttgctttataaaaagaagatatcaatgaacttctatgaaatggtttcacgggattcagccaattgtcttgatcgtgggatatcattgagaaataggaatccatgttatcaaaagatttcctgcgattatttctagtatggaatgagtcaatcatccactttggtatcttattgaccaaaaatggtgatattgttcctccattgatcaagaatttcggtttttgagaagtattatgatcatccaataagaaaggtttcaattttttcaaatgaacgatttgaagacctattgattctaacaactgattgcaaagttgatcattcggacctttcaattcatagatgtggatctcagacctatgaatggggatattcccgaaactcacaaagaaaaaaggaagtgagttagacaaaaagagaagcaacttggacaaaaagagaagtaacttggacaaaaagaaacgaagtgacttagacaaatcttttttgtcgataacctcagaccaatcaatcgaatattgattaatacgtaatcgatcgaacactacttgaaaacggctcttctgctcagaaacgaaatgttccaaatgctcctggaaattcttgctcccattggaccatttgtatctatatgcattaggatcccgattcatggatctctcggtccgagaaatcaaaataagaggatcgaaccatttcttctgactctttttcaaattcgataaatgttggttgatcgtatatttcattatagttctatgattcagagtatcatttcctatttgatccctttgaattccatattcgaagttgcgatcggatcgattctttttaatgaatcgattcaatccatttcttatgtacccataggtgctatattggatttgaatcagatttcggatcaatctatcttgattgactgcctccattatgttgttgctagcaaataccactatttttggttttggatcttccaaatcattcccgcaggagatccggacccatttttttctgatccttcgataaaaagattcattttcttcataaaaaataggaggtagagccgataaagatttctttttcgattcatccctggagttgaatacctcattcaagaattgtttttgatccaatccgtaggaatcaatagaaaaggcaaatcccttataatacaccagatccggctcggttattgatagagtgaatagatctgccatttcttgaaatctctcttctgattcaaaatcgtggtgtaacgtgtatcccctcctgttctggtcatggaatagatgaaataaatcaaaaaatggatttttgttcaagaatgaaatcttattggaactgcccagttcatccttcggaaccatatcacatcccggatctgatgaaataggatgaattgagacggtattttgtaaatacgtaattatcttgaatatattaactatttctttattttccgatcgcctggaagggacaaaagaaacatcttgttctttcttcaacaatttctgatctctagtggacctctcagtagggttcgaacccagatgaagttctgaccatctatcagagaaaaaagaacgaatggatcttgtaggattcccaagaaattcttcgatttcttccggaagcagatgattattcatccgcttctcacgttccgtgaatagccgggacattgaggaatatccagaaaggcacttagggaatcggtctgattctatctccgttcgttccgtttgaagaaaggaaggatcccaaagaatcgatctttcttttagttgttgaatctctctttgattgatcaatgtgtgatattccgaatcctcattactaatggaatcgaaacgatctctggattgatcagaagatcctttcaattggcgagaatccgttacttgaacgaaactagatcttgtggaatcatattgaatatttgacgatacattccgtaccttgctaaaaaatcgatccctgtttaccaaccatacattgtctaaccaaatccaattctctctcgatatgttcctcaaaaaatccgattcgtgtggattcttcccccaactaacgaagagatcttggcggaattgccacatatgaaattgagcacaattttgcaaagaaatagcccacttgcctctcgagaagagatgggaaacatgctcaatatcatttgattgaatagttgacccagctccttgttgtttgaagaaaccctccacttcaattggtattttttcacgaaaagcaaacatgagataacaaatccagtctttcactaagatttcgaatagctgtcccgagttcaagttgattatgtttcgcctcttactcggagaaagacgatcaaacaattcccaatcatggtccttgcggatcgaatcatccatataatatacaaaaagaaactccagatatttgatatctttctctttgaatgagatctcaattccagcgacggtttcattagatatcttacaactagaatccctcttttttccgatccagttcctccacccccgcgaaccccggttagattcaggcatgatacactttttagttattgggagaacccaagtactctctttcggatccaggaaacagctctcagagatcttttttccttttggaagatacaggagcgaaacaatcaacctattgatattggaagacccaaaagattcttccaatgtatcatttctgggtccaatggaattcataggtataggaagaagccctgtcaaatagagattttttctttcgaccatatttcgattgttaatacgatatataaggaccgctactacaaatagtactacacccttgatcgtgaaatatcgattgcttgttgaaccctgtgaattgcgtgaaagtaggatactccaaattcgggggtccaagagttttataaaacgttcttggtggaaaaaaatgtgaatgaaagatcccactgaattgaattgggtccatgaatctaagaaatagtgagaattcttgatctctctcaatatctctctcaattcgaaaatccaggatttgaattgatgtcctttcattgattcctcctaaattgcattgatttatcctaaagatttcatttcaattggaatttggttattcaccatgtacgaggatccccgctaagcatccatggctgaatggttaaagcgcccaactcataattggcgaattcgtaggttcaattcctactggatgcacgccaatgggaccctccaataagtctattggaattggctctgtatcaatggaatctcatcatctatacataacgaattggtgtggtatattcatatcataacatatgaacagtaagaactagcattcttattgagactcgaactcatagggaagaaaatagatttatggatggaatcaaatatgtagtagttacagacaaaagtattcggttattggtgaaaaatcaatatacttctaatgtcgaatcaggatcaactaggacagaaataaagcattgggtcgaactcttctttggtgtcaaggtaatagctatgaatagtcatcgactccccggaaagggtagaagaatgggacctattatgggacatacaatgcattacaggcgtatgatcattacgcttcaaccgggttattctattccacctcttagaacgaaaagaacttaaatcaaaatacttaatagcatggcgatacatttatacaaaacttctaccccgggcacacgcaatggagccgtagacagtcaagtgaaatccaatccacgaaataatttgatctatggacagcatcgttgtggtaaaggtcgtaatgccagaggaatcattaccgcaaggcatagagggggaggtcataagcgtctataccgtaaaattgattttcgacgaaatgaaaaagacatatatggtagaatcgtaaccatagaatacgaccctaatcgaaatgcatacatttgtctcatacactatggggatggtgagaagagatatattttacatcccagaggggctataattggagataccattgtttctggtacagaagttcctataaaaatgggaaatgccctacctttgagtgcggtttgaactattgatttacgtaattggaaggaaccaattaggtttacgacgaaacctaaaaatcgatcactgatccaatttgagtacctctacaggatagacctcaacagaaaactgaagagtaacggcagcaagtgattgagttcagtagttcctcatataaaattattgactctagagatatagtaatatggagaagacaaaattgtttcaagcaccgacagaaccagaagcgccccttgtttcaaagagaggaggacgggttattcacatttcatttgatggtcagaggcgaattgaaagctaagcagtggtaattctaaagattccccgggggaaaaatagagatgtctcctacgttacccataatatgtggaagtatcgacgtaatttcatagagtcattcggtctgaatgctacatgaagaacataagccagatgacggaacgggaagacctaggatgtagaagatcataacatgagtggttcgacagatttggattcctatatatccactcatgtggtacttcattgtacaatatatataagaattatacgataagaattatacgaatccatctgtatagatatcatcatctacatccagaaagccgtatgctttggaagaagcttgtacagtttgggaaggggttttgattgatcgatcaaaaagaagaatctacttcaaccgatatgcccttaggcacggccatacataacatagaaatcacacttggaaggggtggacaattagctagagcagcgggtgctgttgcgaaactgattgcaaaggaggggaaatcggccacattaaaattaccttctggggaggtccgtttgatatccaaaaactgctcagcaacagtcggacaggtggggaatgttggggtgaaccagaaaagtttgggtagagccggatctaaatgttggctaggtaagcgtcctgtagtaagaggagtagttatgaaccctgtagaccatccccatgggggtggtgaagggagggctccaattggtagaaaaaaacccgcaaccccttggggttatcctgcacttggaagaagaagtagaaaaaggaataaatatagtgataatttgattcttcgtcgacggagtaaataggagagattatttctttcttcgtctttacaaaaacaaaaaaatatatttttaaagtaaaaaaaatggcgcgttcactaaaaaaaaatccttttgtagcaaatcatttattaaaaaaaatcgaaaggcttaatacaaaagcggaaaaagaaataataataacttggtccagagcatctaccattatacccacaatgatcggccatactatcgctatccataatggaaaagaacatttgcccatttatataacggatcgtatggtaggacataagttgggagaattcgcacctactataaattttcgcggacacgcaaaaaatgataataaatctcgtcgttaatattattataataaattataataaaaaaaatagagattaattaatgaattcattagtgagaggtaaactttatgataaagataaagaaacacaggaggaacccatatacaacttcagacgaagtatacgctttaggtcaacatatatgtatgtctgctcacaaagcacgaagaataattgatcagattcgtggacgttcctacgaagaaacacttatgatactagaactcatgccttatcgagcatgttatcccattttaaaattggtttattctgcagcagcaaatgctcgtcacaataggggtttcaatgaagcgagtttaatcattagtcaagtcgcagtaaatgagggaactactctgaaaagactaaaacctcgagctcgaggacggagttatctgataaaaagacccacttgtcatataactattgcattgaaagatcttgaatttgaaccacttgacagatatatgctgcgcccaaaaccaaaaaacaccggatggctaggatggctaaaaaagggataaataagaacacaaatatgacatatcctaatatatagtagtggaggattatgggacaaaaaataaatccacttggtttcagacttggtacaacccaaagtcatcattctctttggtttgcacaaccgaaaaagtattccgagggtctacaagaagataaaaaaataagagactgtatcaagaattatgtacaaaaaaatatgagactatcttctggtgtcgagggaattgcacgtatagaaattcaaaaaagactggatctaattcaggtgataatctatatgggatttcctaaattattaattgaagataagccacgaaaactcgaagaactacagatgaatgtgcaaaaagaacttaattgtatgaaccgaaaactcaacattgctattacaagaattggaaatccttatgggcaccctaatattcttgccgaatttatagccggacaattaaagaatcgagtttcatttcgaaaggcaatgaaaaaggctattgaattaactgagcaagcggatacaaaaggaattcaaatacaaattgcagggcgtatcgacggaaaagaaatcgcacgtgtcgaatggatccgagaaggtagggttcctctacaaaccattggagcgaaaattgagtattgctcttatagagttcgaactatctatggggtattaggaatcaaaatttggatatttatagacgaagaataataagaataagactctacttgtctttccgttctattctgcgatagaacaaaaaatgacaaattctttgattttttgattgaacataaaaatcaaaaaatgagcagttctaaattctataaggttaaataaaaatttgattgatcatttgatataattgctatgcttagtgtgcgactcgttgggtttttaggcttaggattcaaaaaaaatgggcggaccacagtataagctaataactatagcactaataaccaactcatcgcttcggattatctggatccaaagaatcagtcaagatatgatatattggtcatatcat

SEQ ID NO: 9119 - DNA, 913 bp, Medicago truncatula
ggtcataagcgtctataccgtaaaattgattttcgacgtaatgaaaaagacatatatggtcgaatcgtaactatcgaatacgaccctaatagaaatgcacacatttgtctcatacactatggggatggtgagaaaagatatattttacaccccagaggggctataattggagataccattgtttatggtacagaagttcctataaaaatgggaaatgccctacctttgaaatctacttcaaccgatatgcccttaggcacggccatacataacatagaaataacacttggaaagggtggacaattagctagagcggctggtgctgtagcgaaactgattgcaaaagaggggaaatcggcaacattaaaattaccttctggagaggtccgtttgatatcaaaaaactgctcagcaacagtaggacaagtagggaatgttggagtaaaccaaaaagtttgggcagagccggagctaaacgttggttaggtaagcgtcctgtagtaagaggagtagttatgaaccctgtagaccatccacatggtggtggtgaagggagggccccgattggtagaaaaaaaccctcaactccttggggttatcctgcacttggaagaagaagtagaaaaaaaaataaatatagtgataatttgattcttcgtcgccgtagtaaatagtctagagtagagaaaatagaatttgtttcttcgtctttacaaaagaaaagagtgatttactatgacattatatgatttgattttgtttttttagagattatataattttattttttaaaatataagagaaaaaattcacttttttagaaattataagaggaataattaactatgacacgttcacgaaaaaaaaatccttttgtagcaaatcatttattaaaaaaaataaataagcttaa

SEQ ID NO: 9120 - DNA, 477 bp, Cajanus cajan
tcaaaaagaagaatctacttcaaccgatatgcccttaggtacggccatacataacatagaaatcacactcggaaagggtggacaattagctagagcagcaggtgctgtagcgaaactaattgcaaaagaggggaaatcagccacattaaaattaccttctggggaggtccgtttgatatccaaaaactgctcggcaacagtcggacaagtgggaaatgtgggggtaaaccagaaaaatttgggtagagccggatctaaatgttggctaggtaagcgtcctgtagtaagaggagtagttatgaaccctgtagaccatccgcatgggggtggtgaagggagggccccaattggtagaaaaaaacccgcaactccttggggttttcctgcacttgggaaaagaagtagaaaaaggaataaatatagtgataatttgattcttcgtcgtcgtagtaaatagtagagaaaattgaaattgtt

SEQ ID NO: 9121 - DNA, 5274 bp, Orobanche aegyptiaca
ccctacggtacgcataactcgtacaacggattagcaatccgccgctttagcccaactcagccacctctccctactaattatacattatgcatatagatattaaatcgggtaaaggagacctattataggacatacaatgcattacatatgtatgatcattacatagaattcaaccgggtcattctattccacccattaataaaaatatttaataacatgatacatttatacaaaacttctaccctgagtacgcatacacgaaataatttgatatatggacaacattattgtggtaaaggtcgtaatgccagaggaatcattaccataaaccatagaggaggaggtcataaacgtctctaccgtaaaattgattttaaacggaataaaaaagacatatatggtaaaatcgtaaccatagaatatgatcctaatagaaacgcacacatctgtctcatacactatggggatggtgagaagagatatattttacatccaaaaggagctaaaattggagatattgttgttgtttctagtacaagagttcttataaagatgggaaatgccctgcccttgaccaatatgcccttaggcgcggccatacataatattgaaattacacccggaaggggtggacaattagttagagcagcaggtgctgtagcaaaactaattgcaaaagagggaaaatcggtcacattaaaattaccttctggggagatccgtttgatatctcaaaactgcttagcaacagtaggacaagtggggaatgttggtacaattcataaaagtttgggtaaagccggatccaagcgttggttaggtaagcgtcctgtagtaagaggaatagttatgaaccccgtagaccatccccacgggggtggtgaagggaaagctccaataggtaaaaaaagacccacaactccgtggggttatcctgcactggcaaaagaagtagaaaaatgaataaatatagtgaaaattttattattcgtcgacgtagtaaataagtaaataggtgataaattccatttctttcctcgtctttacaactaaaataataggagcaagctatgatacgtccactaaaaaaaaaaatccttttgtagccaatcatctattaagaaaaatttacaaagttaataaaaaagcagaaaaagaaataatagtaacgtggtcccgtgcatctaccattatacccataatgatcggccatacaattgcaatttataatggtaaggaacatttacctatttatataagaaattatatgataggtcacaaattaggagaatttgtacctacttcaaattataaagagtatgaagaaaaaagtgatactagatctcatcgttaagttaatctttttataaattaggtatttataattaattactaggagaaaaaccttttatgctaaaagagagaaagaaaaaaataaaagaaatatacgctttaagacgacatatatctatatctgctgacaaagcaagaagagtaattgatcaaattcgcggacgttcttatgaggaaacacttatgatactggaacttatgccctaccgagcatcttatcctattttaaaattggtttattctgcagcagcaaatgctgcttacagtataggttctgttgaaaccaatttagtaattagtaaagctgaagttaatgagggtactaccacaaaaaaattcaaaccccgagctcgtgggcgcaattatgcaataaaaaaaactacctgtcatataattattgtagtgaaagatatatctttagatgagtatgagaaaagatactctagtagtgtgaggtaatatgggacaaaagataaatccacttggtttcagacttggtataactcaaagtcatcattcattttggtttgcacaaccacaaaattattcggaaagtctacaagaagatcaaaaaataagagattttataaaaaattatatacaaaaaaattcaatagaaaagaataaaagaatatactctggcaccgaaggaattgcccgtatagagattaaaaaaagatcaatttgattgaagtcataatttttatgggattccccaagttcttaattgaaagtaaaccccgaggattcaaagaactacagataaatctacaaaaagaatttcattatttgaaccaaaaattaaatattgctattgaaagaattaccaagccttatagaaacgctaatattattgcggaatttatagctgtacaattaaaaaatagagtttcttttcaaaaagtaatggaaaaggctattgaattaacggaagaagaagatataaagggaattcaaatacaaatttcaggacctctcggcggaagagccgctaaatcaagtgtcgaatggatcagacagggtaggattcctttccaaaccattacagctaaaattgattattgttcccataaagttcgtactaaatacggagtattaggtattaaagtttggatttttatagacaaataaaaagaaaactttaattttatcttctatctattaactatattatatgactaaaaaaaagtaaataattcattcttttttaaccaatcaaatttatatttacataaggtaaaaataacaatttgattgactttttgatttgctatgcttagtgtgtgattcattggtttttgctaatgttaggattaaacaaaataagctcattagtctatctgaaaaccaacccgttaattcgtattatctgaatctcaataatcagtcaagatgtgttaaataggtgtcatatctttgtaacaactgaaatttatttgaataaagttgcattatttttataagtttaagacaaaataaagatcgtagggtgtgagtggataactgggaggatgagagaaagataaaaaatataaaaaacgatatataattccaatatgtaaggtctatgagtcatctcataaaagacaatgtaataaagcatcaatactaatttataataaattataataaaatgaatttacataatagaagaaaaaataaagagcttagagccaagcaagactaagaaggttgactcaaaaattatattgtgagctccgttgtataattatgacctaaccattaaatatgaagcggcgggaacgatgaaatctgtgagtagataaaattttatttaataaaattaatcttactgattcaatagtagggatggcgaaatgaaccagaaattaatttatctattgagcgaagtcatgaaaaggcgctacgactggaataaagattttaagagtaaatattcgctcgcgaaaactttatcttttatttattaataaacaaagattataaaaaaatatctttttatattataaaatttaattattttattcgcgaggagctggatgagaagaaactctcacgtccagttctgtagtagagatggaattaaaaaaaacttatctgtcgactataaccccaaaaaaacgagattccgtaaacaacatcgaggaagaatgaagggaagatcttatcgaggtaattatatttctttcggtaaatatgctcttcaagcacttgaacctgcttggatcacatctagacaaattgaggcaggtcggcgagcaatgacacgaaatgtacgtcgtggtggaaaaatatgggtccgtatatttccaaataaaccagttacagaaaaatcggccgaaacacgtatgggttcaggaataggtaaaggatcccctaaatattggatatctgttgttaaaccgggacgaatactatatgaaatgggcggggtgaccgagaatatagccagacgggctattttaatagcagcatcaaaaatacctatacgaacaaagtttattatttctagataaaaaatttataagcggcgaaatttgtcttgttataaaaccgtggttttatttttttatataaaaaatatttcttttattttcttcatacattacattgaaaacctagactgaaaatttatatgattcaacctcagacctatttaaatgtagcagataacagtggggctagaaaattgatgtgtattcgaataataggagctagtactcgtcgatatgctcatattggtgacgttattgttgctgtaataaaaaaagcagtaccaaacatgtccctagaaaaatcagaagtagtcagagctgtaattgttcgtacttgtaaagaacttaaacgtgataacggcatgataatacgatatgatgataatgctgcagttgttattgatcataaaggaaatccaaaaggaacccgaatttttggtgcaatccctcgagaattgaggcaattcaattttactaaaataatttcattagctcccgaaatcttataaaaatataaaattggttgtgataactttaaggtataggtattaaaaataaatagattaatttgtagattttgtattacgcatatatcttgaaaattcatatttataaaaaaacatgttgattatatataattttgggacaccaataattttagtttatcatgggtagagacactattgctgaaataataacctctatacgaaatgctgatatgaatagaaaaagagttgtttgcatatcatctactaatattacagaaaatattgttaaaatacttttacgagaaggttttatcgaaaacatcagaaaacatcgagaaaaaaatagagatttttttgttttaaccttgcgacatagaaaaagatcctatagaaattttttaaacttaaaacagatcagtcgacccggattacgaatctattctaactatcaacgaattcctcgaattttaggaggaatgggggttgtaattctttctacctcgagaggtataatgacagaccgcgaggctcgactaaaaagaatcggcggagaaattttgtgttatatatggtaatacttttaatatccaaatgaaattataaacctcttcctattaaaaaaaaaaagcaggggatgaattatttaatataatttatggaggcttgaaatggaagaaaaaaaggtgatccatgaaggtttaattaccgaaacgtttccaaatggcatgtttcgggttctattagataatgaggatctgattataggttatatttcaggaaatatccgacgtaaatcgatacagatactgcggggagataaagtacgaattgaagtaagtaattataattcaaccagaggacgtataatttctagactcccaacaaaaaaaaataagaattataaagattaaatatattttcttaaatagtattctaaataaacaattaaaagaaac

SEQ ID NO: 9122 - DNA, 3473 bp, Artemisia annua
ttttggaagatacagaagcgaaacaatcaacctattgatattagaagacccaacggattcttccaatgtatcatttctgggtccaatggaattcataggtataggaagaagccctatcaaatagagaatttttctttcgaccatatttcgattgttaatacgatatataaggaccgctactccaaagagtattacacccttgatcgtgaaatatcgattgcttgttgaaccctgtgaattgtgtgaaagtaggatactccaaattcgggagtcaaaaagttttataaaacgttcttggtggaaaaaaatgtgaatgaaagatcccactgaattgaattgggtccaggaatctaagaaatagtgagaattcttgatctctctcaatatctctctcaattctaaaatccaggacttgaattcatgtcctgtcattaaattcctcctgatttattagaactaaaagaattccatttaagcatctcattgctttagttgaaagattccatttgaattggaatctggtcattcactatgacccgctaagcatccatggctgaatggttaaagcacccaactcataattggcgaattcgtaggttcaattcctactggatgcacgccaatgggaccctccaataagtctattggaattagctctgtatcaatgaaatctcatcatccatacataacgaattgatgtggtatattcatatcatactatatgaacagtaagaattagtagtcttattgagactagaactcatagggaatcaaatctatttatggatggaatcaggtatgcagtatttacagacaaaagtattcggttattggggaaaaatcaatatacttttaatgtcgaatcaggatcaactaggacagaaataaagcattgggtcgaactcttctttggtggcgatgaatagtcagcgacttcggggaaaggctagaagaatgggacccattatgggacagacaatgcattacagacgtatgatcattacgcttcaaccgggttattctattccacctcttagaaagaaaagaacttaaatcaaaatacttaatagcatggcgataaatttatacaaaacttctaccccgagcacacgcaatggaaccgtagacagtcaagtgaaacgaaataatttgatctatggacagcatcattgtggtaaaggtcgtaatgccagaggaatcattaccgcagggcatagagggggaggtcataagcgtctataccgtaaaatagattttcgacggaatgaaaaagacatatatggtagaatcgtaaccatagaatacgacccgaatcgaaatgcatacatttgtctcatacactatagggatggtgagaagagatatattttacatcccaggggggctataattggagataccattgtttctggtacagaagttcctataaaaatgggaaatgccctacctttgagtgcggtttgaactattgatttacgtaattggaagtaaccaattaggtttacgacgaaacctagaaatcgatcactgatccaatttgagtacctctacaggatagacctcaacagaaaactgaagagtaacggcagcaagtgattgagttcagtagttcctcatataaaattattgactctagagatatagtaatatggagaagacaaaattgtttcaagcaccgacagaaccggaagcgccccttctttcaaagagaagaggacggattattcacatttcatttgatggtcagagtcgaattgaaagctaagcagtggtaattctaaagattcccggggggaaaaatagagatgtctcctacgttacccataatatgtggaagtatcaacgtaatttcatagagtcattcggtctgaatgctacatgaagaacataagccagatgatggaacgggaagacctaggatgtagaagatcataacatgagtgattcggcagattttgattcctatatatccacccatgtggtacttcattataccatatatataagatccatctgtatagatatcaccatctacatccagaaagccgtatgctttggaagaagcttgtacagtttgggaaggggttttgattgataaaaaagaagaatctacttcaaccgatatgcccttaggcacggccatacataacatagaaatcacacttggaaagggtggacaattagctagagcagcgggtgctgtagcgaaactgattgcaaaagaagggaaatcggccacattaaaattaccttctggggaggtccgtttgatctcagcaacagtcggacaagtggggaatgttggggtgaaccagaaaagtttgggtagagccggatctaagcgttggctcggtaagcgccctgtagtaagaggagtagttatgaaccctgtagaccatccacatgggggtggtgaaggaagggccccaattggtagaaaaaaacccacaaccccttggggttatcctgcacttggaaaaagaactagaaaaggaataaatatagtgataatttgattctcgtcgccgtagtaaataggagagaaaatagaatttctttcttcgtctttacaaaaaaaataggaggaagctgtgacacgttcactaaaaaaaatccttttgtagcgaataatttattaaaaaaataaataagcttaacacaaaagaagaaaaagaaataataataacctggtcccgggcatctaccattatacccataatggttggccatactattgcaatccataatggaaaggaacatttacctatttatataacagatcgtatggtaggacacaaattgggagaattcgcacctactttaaatttccgaggacatgcaaaaagcgataataggtctcgtcgttaaatttatttatatatttattataattataataaaataatatatatagatatttatcattgattagtaggaatttattagtaggaggcgaactttttgaaaccgattaattgattaaactaactctatataaactattagcggctataccaaactctaagatgcaagaaaccattacattttacacagataccctaacaacattacaatgtactaatcatctcacattcccctcagttcttcgccttcctacctccagtgatgcctttggcttcaaagccttcttcacaggtgtcatagccttagccactggcgccttctttcctggtgcagaccttgctgatgtccttgcaaccttagcaggctttgttggcgtctttggcttagccttggacttcacagcagcagctttcggcttagcggcagtctttgctttcgcagctggtttggctttcacaaccgcctttggcttagctacagctttcgcttttggtgcagccttgggcttagcaacggccttcttggcagggcttagctttcttctttgccttagcgggagcagcagtcgatgcagacttggcagcaggtagcttgtaagtgtcgagcgt

SEQ ID NO: 9123 - DNA, 675 bp, Lotus japonicus
ggtcataagcgtctataccgtaaaatcgattttcgacggaataaaaaaacatatatgggaaaatcgtaaccatagaatacgaccctaatcgaaatgcatacatttgtctcatacactatggggatggtgagaaaagatatattttacaccccagaggggctataattggagataccattgtttctggtacagaagttcctattaaaatggggaatgccctacctttgaaatctacttcaaccgatatgcccttaggcacggccatacataacatagaaatcacattcggaaagggtggaaaattagctagagcagcaggtgctgtagcgaaactgattgcaaaagaggggaaatcggcaacattaaaattaccttctggggaggtccgtttgatatccaaaaactgctcagcaacagtcggacaagtaggaaatgttggggtaaaccagaaaagtttgggcagggccggatcgaaatgttggctaggtaagcgtcctgtagtaagaggagtggttatgaaccctgtagaccacccccatggggggggtgaagggagggcccccattggtagaaaaaaacccgtaactccttggggttatcctgcacttggaagaagaagtagaaaaaggaagaaatatagtgataatttgattcttcgtcgccgtactaaatagt

SEQ ID NO: 9124 - DNA, 2450 bp, Tripterygium wilfordii
aaaatagacgagaaagattgcacattttgatctttttttagtttctaaaaaaagatcaaaatgtgatacaaaatgatgaagtgaaaatgaaaatagtacaaactcaaacttttcgaatttcgaaataagaagtataagggcggatgtagccaagtggatcaaggcagtggattgtggatccaccatgcgcgggttcaattcccgtcgttcgcccatttctttttttttgtattcttttttattaacgacgagatctattatcattttttgcatgtccccggaaattgagagtaggtgcaaattctcccaatttatgtcctaccatccgatctgttatataaagaggcaaatgttcctttccattgtggatagcaatggtatgtccgatcattgtgggtataatggtggatgcccgggaccaagttactattatttctttttccgcctttgtgttaagcttatttatttttcctaataaatgattcgctacaaaaggatttttttttagtgaacgtgccacagttaattactcctattttttttgttaaagatgaagaaacaaattctattttctctcctatttactacggcgacgaagaatcaaattatcgctatatttattcctttttctacttcttcttccaagtgcaggataaccccaggggtacgggttttttctaccaattggggccctcccttcaccacccccatggggatggtctacagggttcataactactcctcttactataggacgcttacccagccaacatttagatccggctttacccaaacttttctggttcactccaacattccctacttgtccgactgttgctgagcagtttttggatatcaaacggacctccccagaaggtaattttaatgtggccgatttcccctcttttgcaatcagtttcgctacagcacctgctgctctagctaattgtccaccctttccaagtgtgatttctatgttatgtatggccgtgcctaagggcatatcggttgaagtagattcttctttttgatcaatcaaaacctcttcccaaactgtacaagcttcttccaaagcatacggctttctggatgtagatgatgatatctagacagatggatcttatatatatcgtagaatttatatatacatcgtataatgaagtaccacatgagtggatatataggaatccaaatctgccgaatcgctcatgttatgatcttctacatcctaggtcttcccgttccttcatctggcttatgttcttcatgtagcattcagaccgaatgactctatgaaattacgtcgatacttccacatattacgggtaacttaggagacatctctatttttcccctggggaatctttagaattaccactgcttagctttcaattcgcctctgaccatcaaatgaaatgtgactaacccgtcctcctctctttgaaacaaggggcgcttctggttctgccggtgcttgaaacaattttgtcttctccatattactatatctctagagtcaataattttatatgaggaactactgaactcaatcacttgctgccgttactcttcagttttctgttgaggtctaccctgtagaggtactcaaattggatcagtgatcgatttctaggtttcgtcgtaaacctaattggttacttccaattacgtaaatcaatagttcaaaccgcactcaaaggtagggcatttcccatttttataggaacttctgtaccagaaacaatggtatctccaattatagcccctctgggatgtaaaatatatctcttctcaccatccccatagtgtatgagacaaatgtatgcatttcgattagggtcgtattctatggttacgattctaccatatatgtctttttccttccgtcgaaaatcgatttgacggtatagacgcttatgacctccccctctatgccctgcggtaatgattcctctggcattacgacctttaccacaacgatgctgtccatagatcaaattatttcgtgtattggatttcacttgactgtctacggctccattgcgtgtgctcggggtagaagttttgtataaatgtatcgccatgctattaagtattttgatttaagttcttttcgttctaagaggtggaatagaataacccggttgaagcgtaatgatcatacgtctgtaatgcattgtatgtcccacaatagggcccattcttctaccctttcccgggggtcgatggctattcatagctattaccttaacaccaaagaagagttcgacccaatgctttatttctgtcctagttaatcctgattcgacattaaaagtatattgatttttccccaataaccgaatacttttgtctgtaaatactgcatatttgattccatccataaatctcttttcttccctatgagttctagtctgaataagaatgctagttcttactgttcatatgtt

SEQ ID NO: 9125 - DNA, 447 bp, Lotus japonicus
aatctacttcaaccgatatgcccttaggcacggccatacataacatagaaatcacattcggaaagggtggaaaattagctagagcagcaggtgctgtagcgaaactgattgcaaaagaggggaaatcggcaacattaaaattaccttctggggaggtccgtttgatatccaaaaactgctcagcaacagtcggacaagtaggaaatgttggggtaaaccagaaaagtttgggcagggccggatcgaaatgttggctaggtaagcgtcctgtagtaagaggagtggttatgaaccctgtagaccacccccatggggggggtgaagggagggcccccatttgtagaaaaaaaccccgtactccttggggttatcctgcacttggaaaaagaagtagaaaaaggaagaaatatagtgataatttgatttctcgccgccgtactaaatagt

SEQ ID NO: 9126 - DNA, 1220 bp, Juglans hindsii x Juglans regia
atgccctacctttgagtgcggtttgaactattgatttacgtaattggaagtaaccaattaggtttacaacgaaacctagaaatcgatcactgatccaatttgagtacctctacaggatagacctcaacagaaaactgaagaggaacggcagcaagtgattgagttcagtagttcctcatataaaattattgactctagagatatagtaatatggagaagacaaaattgtttcaagcaccgacaaaaccagaagcgccccttgtttcaaagagaggaggacggattattcacatttcatttgatggtcagaggcaaattgaaagctaagaagtggtaattctaaggattccccgggggaaaatagagatgtctcctacgttacccataatatgtggaagtatcgacgtaatttcatagagtcattcggtctgaatgctacatgaagaacataagccagatgaaggaacgggaaaacctaggatgtagaagatcataacattattgattcggcagatttggattcctatatatcactcatgtggtacttcattatacgatatatatatataaattatacgatatatataagatccatctgtatagatatcatcatctacatccagaaagccgtatgctttggaaaaagcttgtacagtttgggaagaggttttgattgatcaaaaagaagaatctacttcaaccgatatgcccttaggcacggccatacataacatagaaatcacacttggaaagggtggacaattagctagagcagcaggtgctgtagcgaaactgattgcaaaagaggggaaatcggccacattaaaattaccttctggggaggtccgtttgctatccaaaaactgctcagcaacagtcggacaagtggggaatgttggggtgaaccagaaaagtttgggtagagccggatctaaatgttggctaggtaagcgtcctgtagtaagaggagtagttatgaaccctgtagaccatccccatgggggtggtgaagggagggccccaattggtagaaaaaaacccgcaaccccttggggttatcctgcacttggaagaagaagtagaaaaaggaataaatatagtgataatttgattcttcgtcgccgtagtaaataggataggagagaaaatagaatttgtttcttcgtctttaaaataaaaaaaaaataggagtaattaattgtgacacgctcactaaaacg

SEQ ID NO: 9127 - DNA, 831 bp, Conyza canadensis
tgggcatagagggggaggtcataagcgtctataccgtaaaatagattttcgacggaatgaaaaagacatatatggtagaatcgtaaccatagaatatgatccgaatcgaaatgcatacatttgtctcatacactatagggatggtgagaagagatatattttacatcccaggggggctataattggagataccattgtttctggtacagaagttcctataaaaatgggaaatgccctacctttgaccgatatgcccttaggcacggccatacataacatagaaatcacacttggaaagggtggacaattagctagagcagcgggtgctgtagcgaaactgattgcaaaagaagggaaatcggccacattaaaattaccttctggggaggtccgtttgatatccaaaaactgctcagcaacagtcggacaagtggggaatgttggggtgaaccagaaaagtttgggtagagccggatctaagcgttggctaggtaagcgccctgtagtaagaggagtagttatgaaccctgtagaccatccacatgggggtggtgaagggagggccccaattggtagaaaaaaacccacaaccccttggggttatcccgcacttggaaaaagaagtagaaaaaggaataaatatagtgataatttgattcttcgtcgccgtagtaaataggagagaaaagagaatttctttcttcgtctttacaaaaaaaaataggaggaagctgtgacacgttcactaaaaaaaaataccttttgttagcgaataatttattaaaaaataaaataagcttaacacaaaagacggaaaaagaaaaatagata

SEQ ID NO: 9128 - DNA, 1092 bp, Eucalyptus grandis
cttcaaccgatatgcccttaggcacggccatacataacatagaaatcacacttggaaagggtggacaattagctagagcagcgggtgctgtagcgaaactgattgcaaaagaggggaaatcggccacattaaaattaccttctggggaggtccgtttgatatccaaaaactgctcagcaacagtcggacaagtggggaatgttgaggtgaaccagaaaaagttgggtagagccggatctaaatgttggctaggtaagcgtcctgtagtaagaggagtggttatgaaccctgtagaccatccccatgggggtggtgaagggagagccccaattggtagaaaaaaacccgcaaccccttggggttatcctgcacttggaagaagaagtagaaaaaggaagaaatatagtgataatttgattcttcgtcgccgtagtaaataggggataaaatcgaatttatttctttttattaattattaaaaaaaataggagtaattaatcgtgacacgttcactaaaaaaaaatccttttgtagcgaatcatttattaataaaaattgagaagcttaacacaaaggcggaaaaagaaataataataacttggtctcgggcatctaccattatacctacaatgatcggtcatactattgctatccataatggaagggaacatttacctatttatataacagatcgtatggtaggccataaattgggagaattttcacctactataaatttccgtggacatgcgaaaaatgataatagatctcgtcgttaacgttaacaatatgaataagttaataaatagatgattagtgatcattagtaagaggtgaaccttatgagaaagaagagaaataagaacctatatggagaagtatatgctttaggtcaacatatatctatgtctgctcacaaagcacgaagggtaattgatcagattcgtggacgttcctacgaggaaacacttatgatactcgaacttatgccttatcgagcgtgttatcccatttttaagttggtttattctgcagcagcaaatgctagtcataatatgggtttcgatgaagcaagtttagttattagtaaag

SEQ ID NO: 9129 - DNA, 2071 bp, Lippia dulcis
gtgcacctcataattggcgaattcgtaggttcaattcctactggatgcacgccaatgggaccctccaataagtctattggaattggctctgtatcaatggaatctcatcatccatacataacgaattggtagattcatatcataatatatgaatcgtaagaactagcattcttattatatgttatatgaaattagatgaatatgaatcgtaagaactagcattcttattgagactagaactcatagggaagaaaatggatttatggatggaatcaaatatgcagtatttacagacaaaaggattcggttattggggaaaagtcaatatacttctaatgtcgaatcaggatcaactaggacagaactaaagcattgggtcgaactcttctttggtgtcaaggtaatagctatgaatagtgaatagtcatcgacttccgggaaagggtagaagaatgggacctattatgggacacacaatgcattacagacgtatgatccttacgcttcaaccgggttattctattccacctcttagaaagaaaagaacttaaatcaaaatacttaatagcatggcgatacatttatacaaaacttctaccccgagcacacgcaatggaaccgtagacagtcaagtgaaatccaatccacgaaataatttgatctatggacagcatcattgtggtaaaggtcgtaatgccagaggaatcattaccgcaaggcatagagggggaggtcataagcgtctataccgtaaaatcgattttcgacggaatgaaaaagacatatatggtagaatcgtaaccatagaatacgaccctaatcgaaatgcatacatttgtctcatacactatggggatggtgagaagagatatattttacatcccagaggggctataattggagataccattgtttctggtacagaagttcctataaaaatgggaaatgccctacctttgagtgcggtttgaactattgatttacgtaattggaagtaaccaattaggtttacgacgaaacctagaaatcgatcactgatccaatttgagtacctctacaggatagacctcaacagaaaactgaagagtaacggcagcaagtgattgagttcagtagttcctcatataaaattattgactctagagatatagtaatatggagaagacaaaattgtttcaagcaccgacagaaccggaagcgccccttctttcaaagagaggaggacgggttattcacatttcatttgatggtcagaggcgaattgaaagctaagcagtgggaattctaaagattccccgggggaaaaatagagatgtctcctacgttacccatactatgtggaagtatcgacgtaatttcatagagtcattcggtctgaatgctacatgaagaacataagccagatgacggaacgggaagacctaggatgtagaagatcataccatgagtgattcggcagatttggattcctatagatatccacccatgtggtacttcattatatgatatatataagatccatctgtatagatatcatcatctacatccagaaagccgtatgctttggaagaagcttgtacagtttgggaaggggttttgattgatcaaaaagaggaatctacttcaaccgatatgcccttaggcacggccatacataacatagaaatcacacttggaaagggtggacaattagttcgagcagcgggtgctgtagcgaaactgattgcaaaagaggggaaatcggccacattaaaattaccttctggggaggtccgtttgatatccaaaaactgctcagcaacagtcggacaagtggggaatgttggggcgaaccagaaaagtttgggtagagccggatccaagcgttggctaggtaagcgtcctgtagtaagaggagtagttatgaaccctgtagaccatccccatgggggtggtgaagggagagccccaattggtagaaaaaaacccacaaccccttggggttatcctgcacttggaagaagaagtagaaaaaagaagaaatacagtgataatttgattgttcgtcgccgtagtaaataggcgagaaaat

SEQ ID NO: 9130 - DNA, 10075 bp, Ricinus communis
ggattggcgacttacccattcagtgactttggcactggatgttcccaaaataaaatgggtactctcgggtcgggtgaattcaataatagacgtctgttggcattccggccttccttctcctttccgggcctatccgaaagagaatccagtacttcttggtcgtgaatatctgaataggacgaaccgccccgtggatatctttgcttcggaacaaaacaattagaattaggcccggtcaactggaatgtgtattatccatataggggatcctccaattgagaagatccatcgacctgagacgaagagaggggtctatctattttatttagttattcatttagttattcagttaaaccaatgattcgttattggagcagatagcaacaaccaccatttcatccgacatacgtatttttgatttttcaatggatttacatctttcattaatggaaattttttgatgtagtgagtaatagttctggttgctcgctgttcaagaattcttgtttaggcagttcataccatccatacatagtgttttgatctaagatttcaattcttccatgtttcagcagtaacatattgttccatgtccaaaatatggaagaaacaggtgtttccacgactctaccacccagtcaattctgttccacttaatccctatttcatggccacatatctttcaggctaaggaatgggaaacctttctcctattacatgaatccaattttcatttcatccgggaaaagccatctttttctcaacaatgcctttgtcatttgatccaatagcgttccgttagataggaacagatttgataaatactgataactctcggatagagtattcgaacggaaaaatccattagataatgaactattggttctaagccatctctggcgatgaatcaacaattcgaagtgcttttcttgcgtattcttgataaaccagcatttatatatagatgtaggaggatccgtttgggaagtaagaagcccctttgacatctcttcatctgcaaagaattctcgatgtgaaaacacagagacaaggggctgatctttgaataggaaaaagagtggatctgcagggtcccaaatgaattggcttattcgaaaaaagccttgttctttggaggatctatctcgtatctggtactgcatggctccactctgcaagaactccgaatcattctcttgaagctcatcctcttcattataaatgatccgcttgccccgaaatgacctggcccaatagggaaatcccaattcattgggcctttcgatacaatcaaatagaaagccccaagggcgccatattctaggagcccaaactatgtgattgaataaatcctcctctatctgttgcgggtcgaggacttcttctccttccccttcttcaaactccgattcgtatttttcatagagaaatctctgatcaaggatagaacaagatccattttgcatcatatctaagggacttcttggttcgggccgaagaagcaatgtcactcgatcattatcaaactgactgcaatctttttctgtccgtgaggatcccaccagagcgctttctacttctaataggccatgaactagatcagaatcattctcaacaagtccataataagtgatcccatttttttcatcgggtccgggtagagaccaaaggtcttgagcaaccgatccggcagaacaactcaaaagataaagaagtatcgttaatttcttcatgctcgttccaagttcgaagtaccatttgtacaaataagaatccccttcgttacaagatttcttcttcatatagatagatataggatctatggggcaattacttagaaatacattttgtgcaacagcccgtcctatctgatagaaaaggatcccatgatcctgaaccgatcttacctgggatcgcaaatcccaagtttgtctatgaagagcagatctaattatattagtgtctataattgatttcttctgtgtaatactaattgatagggcctcattggtaagtgctacaagatctcgtacattggaacccatggttatggacccgaatccattagtatggaacattttctttttcaagtgaaatcccctagtatatgaaagagtaaaaaagtgctttcgttgttgtggaataagaagccttcgtatcttaatgcatgtatttaatttattcggagctattagagcgggatccacttttttgggaatatgagtcgaagcaataacaagaatatttctagtggaacatctttcacaatccctggagagatagttcactaatagaccgagggataagtaattcgactcattcacatccagatcatgaatgtttggaatccatattatgcaaggagacattgcttttgctaattcgaattgaagggtgatataaaatcggtctatttccggcatcatatccatagttagcgcattcatcctagttagaaactccagctccgtatcaaagtcacggtcgatatcgtcactcacatcaatatcgtcactatcatcaatatcgtcactatcatcaataagaaaacccttaggcttgttatccaggaacttgttcagaaatactgtaatgaaaggaagataggagtttgtcgctaggtatttgaccaaataggatcgtccagtccctatagaacctatcactaaaatacccctagagggggatagggctaagcggagcgaaaagggttttccatgagatgggaaatgaaaactattcaccccacacgaggtttgtgaataagtggttgtctgataataagcaaggaatatccgtctttctgctaaacagggtgtattgaactcataattcattagatactttttatgaatgtcaactaagtatcgtaaataaattgctcccggctcttcaatcacttgataaccagagtcattctttgataaatgatcactatgagtcagactcaatagaatttgatcaatccttttttctgtcgttaaggtggagaactgaaccaagaattctctttctttatcatcaatcgaatcactgttcgcgaccaaggattctattttatcatcaatccaatcaccgttcacgttttttctttttcttatcaatgaataaatctctttacttgtatgacttagatgtctcgtatttctcgaaaaagtgattcgattgatgggatttggtatgatacttatgagatcgatgagattgatattcaaaaatttcttcttagaacgtattgatttaaccccataagcgggaccaccaccccatagcatgttgccgccagaagcagaaccccgcatttcttctagaaaatctcctaattgttccagagaaactagaaagagattctttaaccagaaagaattcagttcagatgtaggatacctatccagaagttttcgcaactcaatcatgtatgatggaatcatcaaagatttgaccttttcgaactctgtctgtaactcactataggctcgggaaacaaagagaagatgtgtacgaacgagatatccagcaacaagaagaaggaaaaggattgaatagaggaactcccgaacatttggcgatctcagatgtgtcgatatcaatggtggctcattatttcgatgaatcatttcttcggacagaagaagattatgtaaacacttactcgaaatctcacttatcagattccattgtggaagacacaattttttctgaagaattcgccatgatatatctgatccatgcataatatcatgaaaaatggatacaaatttttgactgctacttagtatcggtaataggtccgaaaaggtatctaaaaatagcaaatttagaaatttgtaccctgtcgacgtaaggaaccatggcatatatgtttggaatagattccattttgagagagtcgaaaaagcactatctcgttgaaaggttctatacatctgccctttttcaacacatttctttagacaaagactccgctttttcctcttttcggatggtaaatatttctcagaacatggagtgtgaatcaaacccatgtttgaattgaaattgagatactgatgcaagttcttcccttctgaatcagatagattcatatccgaaagaggttgacaataagttctttcaaaattgactatttgtccctctgttagaggtgttccagaaatgtctgcgatcgaataaatcgctctatgaacgaatggatcggatcgaattggaaaatggaaagatttgtacaagttatacctttcgttaccactttgtggaaaatcattaggtatgaatatgttagatacctgtgactcgattggtgaaatagtatctctctccaaaaaagcatgtttttttttaccgccgcacaaagaaaatattttgttgcgaatgaacaagatattgaggaattgtccatacgtaaaatcataattcttgatacgggccttttccacataaaaagggaatcttttgttacaatagaaccagaagtgatgtagattattcaagaatcgaagtcgatttgctttataaaaagaagatatcaatgaacttctataaaatggtttcacgggattcagccaattgtcttgatcctgggatatcattgagaaaaaggaatccgtgttatcaaaagatttcctgcgattatttctagtatggaatgagtcaatcatccactttggtatcttattgaacaaaaatggtgatattgttcctccattaatcaaaaatttcgatttttgggaagtatcatgatcatccaataagaagggtttccattttttcaaatgaacgatttgaagacctattgattctaacagctgattgcagagtggatcattcggacctttcaattcatagatatggatttcggacctatgaatgggaatattcccgaaactcacaaagaaaaaaggaagtgagttagacaaaaagagaagaaacttggacaaaaaaagaagtaacttgggcaaaaagaaacgaagtgacttagacaaatcttttttgtcgataacctcagaccaatcaatcgaatattgattaatacgtaatcgatcgaacactacttgaaaaagaaaacggttcttctgctcagaaatgaaatgttccaaatgttcctggaaattcttgctcccattagaccatttgtatctatatgcattaggatcccaattcatggatctctcggttcgagaaagaaaaataagaggatcgaaccatttcttctgactctgtttcaaattcgataaatgttggttgatcgtatatttcattatagttctatgattcagagtatcatttcctattggatccctttgaattccatattcgaagttgcgatcggatctattcattaaaaagaattgagtcaatacatttcttatgtacccataggtactatattggatttgaatcagatttaggatcaatccatattgattgactgcctccattatgttgttgctagcaaataccactattttttgttttggatcttcaaaatcattcccgcaggagatccggacccatttttttctgatccttcgataaaaagattcattctcttcataaaaaataggaggtagaaccaataaagatttctttttcgattcatccctggagttgaatacctcattcaagaattgtttttgatccaatccgtaggaatcaataaaaaaggtaaatcccttatgatacaccagatccggctcggttattgatagagtgaatagatccgccatttcttgaaatctctcttctgattcaaaatcgcggtgtaacgtgtatccccccccgttccgatcatggaatagatgaaataaatcaaaaaatggatttttgttcaagaaagaaatcttattggaactgtccatatccagttcatccttcagaaccatatcacatcccggatctggtgaaataggatgaattgagacggtattttgtaaatacgtgattatcttgaatatattaactatttctttattttccgatcgcctggaagggacaaaagaaacatcttgttctttcttcaacaatttctgatctctagtgaacctctcagtaggattcgaacccagatgaagttctgacgatctgtcagagaaaaaagaacgaatggatcttgtaggattcccaagaaattcttcgatttcttccggaagcagatgattattcatctccttctcaccttccgtgaatagccgggacattgaggaatatccagaaaggcatttagggaatcggtctgattctatctctgttcgttccgtttgaagaaaggaaggatcccaaagaatcgatctttcttttagttgttgaatctttctttgattgatcaatgtgtgatattccgaatcctcattactaatggaatcgaaatgatctctggattgatcagaagatcccttcaattggctagaattccttccttgaacgaaactagatcttgtggaatcatattgaatatttgacgacatattccgtgccttactaaaaaaccgatccttgtttaccaaccacacattgtctaaccaaatccaattctctctcgatatgttcctaaaaaaatccgattcgtgcgaattattcccccaactaacgaagagatcttggcggaattgccacatatgaaattgagcacaattttgcaaagaaatagcccacttctttctcgagaagagatgggaaacatgctcaatatcatttgattgaatagttgaccgagctccttgttgtttgaagaaaccctccacttcaattgatattttttcacgaaaagcaaacatgagataacaaatccagtctttcactaagatttcgaatagctgtcccgaattcaagttgattatgtttcgccccttcctcggagaaagacgatcaaacaattcccaatcatggtccttgcggatcggatcatccatataatatacaaaaagaaactccagatatttgatatctttttctttgaatgagatctcaattccagcgacggtttcattagatatcttacaactagaatccctcttttttccgatccagttcctccaccaccgcgaaccccagttagattcagacatgatacactttttagttattgggagaacccaagtactctctttcggatccaggaaagagctctcagagatcttttttccttttggaagatacaggagcgaaacaatcaacctattgatattggaagaccaaaaggattcttccaatgtatcatttctaggtccaatggaattcataggtataggaagaagccctgtcaaatagagattttttctttcgaccatctttcgattgttaatacgatatataaggaccactactacaaatagtactacacccttgatcgtgaaatatcgattgcttgttgaaccctgtgaattgcgtgaaagtaagatactccaaattcgggagtccaagagttttataaaacgttcttgatggaaaaaaatgtgaatgaaagatcccacggaattgaattgggtccatgaatctaagaaatagtgagaattcttgatctctctcaatatctctctcaattcgaaaatccaggatttgaattgatgtcctttcattgattcctcctaaattgcattgatttatcctaaagatttcatttcaattggaatttggttattcaccatgtacgaggatccccgctaagcatccatggctgaatggttaaagcgcccaactcataattggcgaattcgtaggttcaattcctactggatgcacgccaatgggaccctccaataagtctactggaattggctctgtatcaatggaatctcatcatccatacataacgaattggtgtggtatattcatatcataacatatgaacagtaagaactagcattcttattgagactagaactcatagggaagaaaatagatttatggatggaatcaaatatgcagtatttacagacaaaagtattcggttattggggaaaaatcaatatacttttaatgtcgaatcaggatcaactaggacagaaataaagcattgggtcgaactcttctttggtgtcaaggtaatagctatgaatagccatcgactcccgggaaagggtagaagaatgagacctattatgggacatacaatgcattacagacgtatgatcattactcttcaaccgggttattctattccacctcttagaaagaaaagaacttaaatcaaaatacttaatagcatggcgatacatttatacaaaacttctaccccgagcacacgcaatggagccgtagacagtcaagtgaaatccaatacacgaaatacacgaaataatttgatctatggacagcatcgttgtggtaaaggccgtaacgccagaggaatcattaccgcaaggcatagagggggaggtcataagcgtctataccgtaaaatcgattttcgacggaatgaaaaagacatatatgggagaatcgtaaccatagaatacgaccctaatcgaaatgcatacatttgtctcatacactatggggatggtgagaagagatatattttacatcccagaggggctataattggagataccattatttctggtacagaagttcctataaaaatgggaaatgccctacctttgagtgcggtttgaactattgatttacgtaattggaagtaaccaattaggtttacgacgaaacctagaaatcgatcactgatccaaattgagtacctctacaggatagacctcaacagaaaactgaagagtaacggcagcaagtgattgagttcagtagttcctcatagaaaattattgactctagagatatagtaatatggagaagacaaaattgtttcaagcaccgacagaaccggaagcaccccttgtttcaaagagaggaggacgggttattcacatttcatttgatggtcagaggcgaattgaaagctaagcagtggtaattctaaagattccccggggaaaaaatagaaatgtctcctacgttacccctaatatgtggaagtatcgacgtaatttcatagagtcattcggtctgaatgctacatgaagaacataagccagatgaaggaacgggaagacctaggatgtagaagagcataacatgagcgattcagcagattttgattcctatatatccactcatgtagtactttttttcattttacgatatataagatccatctgtatagatatcatcatctacacccagaaagccgtatgctttggaagaagcttgtacagtttgggaagaggttttgattgatcaaaaagaagaatctacttcaaccgatatgcccttaggcacggccatacataacatagaaatcacatttggaaagggtggacaattagctagagctgcaggtgctgtagcgaaactgattgcaaaagaggggaaatcggccacattaaaattaccttctggggaggttcgtttaatatccaaaaactgctcagcaacagtcggacaagtagggaatactggggtgaaccagaaaagtttgggtagagccggatctaaatgttggctaggtaagcgtcctgtagtaagaggagtagttatgaaccctgtagaccatccccatgggggtggtgaagggagggccccaattggtagaaaaaaacccgcaaccccttggggttatcctgcacttggaagaagaagtagaaaaaggaataaatatagtgataatttgattcttcgtcgccgtagtaaataggagaaaaaatagaatttgtttcttcgtcttttcaaaataaataaaaaaaaaaaaaaaataggagaaattcactgtgacacgttcactaaaaaaaaatccttttgtagcaaatcatttattaaaaaaaataaataagcttaacacaaaagcagaaaaagaaataatagtaacgtggtcccgggcatctaccattatacccacaatgatcggccatactattgctatccataatggaaaggagcatttacctatttatataacagatcgtatggtgggccataaattgggagaatttgcacctactctaaatttccggggacatgcaaaaaatgataataaatctcgtcgttaattcgttaatcttaattccta

SEQ ID NO: 9131 - DNA, 4171 bp, Coffea canephora
atatgaacagtaagaactagcattcttattgagactagaactcatagggaagaaaatagatttatggatggaatcaaatatgcagtatttacagacaaaagtattcggttattggggaaaaatcaatatacttttaatgtcgaatcgggatcaactaggacagaaataaagcattgggtcgaactcttctttggtgtcaaggtaatagctatgaatagtcatcgacttccgggaaagggtagaagaatgggacctattatgggacatacaatgcattacagacgtatgatcattacgcttcaaccgggttattctattccacctcttagaaagaaaagaacttaaatcaaaatacttaatagcatggcgatacatttatacaaaacttctaccccgagcacacgcaatggaactgtagacagtcaagtgaaatccaatccacgaaacaatttgatctatggacagcatcgttgtggtaaaggtcgtaatgccagaggaatcattaccgcagggcatagagggggaggtcataagcgtctataccgtaaaatcgattttcgacggactgaaaaagacatatatggtagaatcgtaaccatagaatacgaccctaatcgaaatgcatacatttgtctcatacactatggggatggtgagaagagatatattttacatcccagaggggctctaattggagataccattgtttctggtacagaagttcctataaaaatgggaaatgccctacctttgagtgcggtttgaactattgatttacgtaattggaagtaaccaattaggtttacgacgaaacctagaaatcgatcactgatccaatttgagtacctctacaggatagacctcaacagaaaactgaagagtaacggcagcaagtgattgagttcagtagttcctcatataaaattattgactctagagatatagtaatatggagaagacaaaattgtttcaagcaccgacagaaccggaagcgccccttctttcaaagagaggaggacggggtattcacatttcattcgatggtcagaggcgaattgaaagctaagcagtgggaattctaaagattccccgggggaaaaatagagatgtctcctacgttacccataatatgtggaagtatcgacgtaatttcatagagtcattcggtctgaatgctacatgaagaacataagccagatgacggaacgggaagacctaggatgtagaagatcataacatgagtcattcggcagatttggattcatatatccacccatggggtacttcattgtacgatataagatccatctgtatagatatcatcatctacatccagaaagccgtatgctttgtaagaagcttgtacagtttgggaaggggttttgattgatcaaaaagaagaatctacttcaaccgatatgcccttaggcacggccatacataacatagaaatcacacttggaaagggtggacaattagctagagcagcgggtgctgtagcgaaactgattgcaaaagagggtaaatcggccacattaaaattaccttctggggaggtccgtttgatatccaaaaactgctcagcaacagtcggacaagtagggaatgttggggtgaatcagaaaagtttgggtagagccggatctaagcgttggctaggtaagcgtcctgtagtaagaggagtagttatgaaccctgtagaccatccccatggaggtggggaagggagagctccaattggtagaaaaaaacccacaaccccttggggttatcctgcacttggaagaagaagtagaaaaaggaataaatatagtgataatttgattcttcgtcgccgtagtaaataggagaaaaattagagtttttttcttcgtctttacaaaaaaaaaaaaaataggagtaagctgtgacacgttcactaaaaaaaaatcctttcgtggccaatcatttattaaaaaaaattgataaacttaatacaaaagcagaaaaagaaataatagtaacctggtcccgggcatctaccattatacccacaatgataggacataccattggtatccataatggtaaagaacatctgcctatttatataacagatcgtatggtaggccacaaattgggagaattttcacctactttaaatttccgaggacatgcaaaaagcgataatagatctcgtcgttaatattaaatataaaatgatgcttatgagaattcattactattaatttaatataataaataataggaggcaactttatgctaaaaaagaaaaaaacagaagtatatgctttaggttaacatatatctatgtctgctgacaaagcacgaagagtcattgatcaaattcgtggacgttcctacgaagaaacacttataatactagagctcatgccctatcgagcatgttatcccatttttaaattagtttattctgcagcagcaaatgctagttacaatatgggttccaacgacgccaacttattcattagtaaagctgaagtcaatgagggtactaccataaagaaatttaaaccccgggctcgggggcgtagttatccgataaaaagacctacctgccatataactattgtaatgaaagatatatctttagatgatgaatacgtaaagataaattcactaaaaaaacctagatggaaaaataaacatacagctatggtatatcatgatatgtatagtagtggaggagtatgggacaaaaaataaatccacttggttttagacttggtacaacccaaggtcatcattctctttggtttgcacaaccaaaaaattattctgagggtctacaagaagatcaaaaaataagaaattgtattaaaaattatgttcaaaagaatacgaaaatatcctctggggtagagggaattgcacgtatagagattcaaaaaagaatcgatttgatccaagtaataatttttatgggattcccaaaaccattactagaaaatcaaccacgaggaatcgaagaattacagacgaatctacaaaaaaaatttaattctgtgaacagaaaatttaacattgctatcacaaaaattgcaaaaccttatggaaaccctaatattcttgcagaatatatagctgggcaattaaagaatagagtttcatttcgaaaagcaatgaaaaaggctattgaattaactgaacaagcaaatacaaagggaattcaagtccaaattgcaggtcgtatcgacggaaaagaaattgcacgcgtcgaatggattagaaggggtagggttcctctacaaaccattcgagctaaaattgattattgttcctatacagttcgaactatctatggtgtattaggcataaaaatttggatatttatagacgaggaataataaataaactttgacttttccttctatctaatttagaaagctaaacctcttcattctttttctcaaaactagttttaattctataaggttgaataaaaattcgattaatcatttgagaaaattgctatgcttagtgtgtgactcgttgatttttttagggttagaattcaaaaaattggccccctaataaccaacccatcacttcgcattatctcgatctaaagctaaagaaccagtcaagatgtgaccgatatatcacatccttgcagcaactgaaattgattttatgttcttgcaaaaatcaatatgattttaagtcggaaagcaaaatagagaagaaagctgtggataaatggaaggatgagagaaagagaaaaaatatctatgatatagaattccaatatgtaaggtctatgagtgatctcataaaaggcagtgtaataaagcatcaatactgattcatccataattaaatgactcttcttatagaacattttatagtagaacattatagaacaaaacaaaaaaataaagagcttcgagacaataaagactgagaaaattgactcaagaacaaatttcattactaagctccgttgtaaaatttggacctaaacattaaagtaagaagtgatgggaacgatggaaactgtgaatccaaaagattttattaaaaaaaatcttaatgattcgccggtcgggatggcggaacaaaccggagaccaattcatctattctgagaagtaacgagataatactcaaattgaaatggaagagtaaatattcgcccgcgaaaactttct

SEQ ID NO: 9132 - DNA, 2470 bp, Arachis hypogaea
ccgatatgcccttaggcacggccatacataacatagaaatcacactcggaaagggtggacaattagctagagcagcaggtgctgtagcgaaactgattgcaaaagaggggaaatcggccacattaaaattaccttctggggaggtccgtttgatatccaaaaactgctcagcaacagtcggacaagtggggaatgttggggtaaaccagaaaactttgggtagagccggatctaaatgttggctaggtaagcgtcctgtagtaagaggagtagttatgaaccctgtagatcatccccatgggggtggtgaagggagggccccaattggtagaaaaaaacccgcaactccttggggttatcctgcacttggaagaagaagtagaaaaaggaataaatatagtgataatttgattcttcgtcgccgtagtaaatagtagaatagagaaaatcgaatttgtttcttcgtctttacaaaaaataggaggaattcactatgacacgttcactaaaaaaaaaaccttttgtagccaatcatctattaagaaaaataaaaaagcttaacacaaaagcggaaaaagaaataataataacttggtccagaacatctaccattatccccacaatgattggccataccattgctatccataatggaaaagaacatttacctatttatataacagatcgtatggtaggccataaattgggcgaattttcacctactctaaacttccgaggacatgcgaaaaatgataataggtctcgtcgttaaggtgaaatttcatgttcttctaataataataagattactcaaaaataaaacaatttcttttttatattaaaaatttgaataaatactaaaaaaatgaaaagaaaaatcgatttgaaaaataagaaatgtttcttttttttagtaaaagcataaccttacttatgataaagtagaaactagaatcatctttaggttaaacaaaatcgatcaattagatatttatatattagaaatataaaaaatgaaaattatataaatagaaatgtctgttcacaacacaaaacatgaataggaataaatgagatttgtggatgtggataagaaatggttatgatactataatttacgttttattgaattgagtatctttttccagtttttgcgtttattctgcagaagcaaattaagtcaaaaggggatgctatattatgtttttaaataaaaagcctaatggatataaaaaaacaaagtgcacaactagggcatatcattttatgtaaagtagtggagaattatgggacaaaaaataaatccgcttggtttccgacttggtacaactcaaagtcatgattctctttggtttgcacaaccaatcaattattcagagaatctacaagaagataaaaaaatacgagattatatcaagaattatataaaaataaatataagaatatcttctggtgtcgagggaatagcagggataaagattaaaaaaagaattgatttgattcaagtcataatctctatgggatttccaaagttattaattgagggtaagcctggaagaatagaagagttacagatgaatttacaaaaaaaactcaattgtgtgaaccgaaaactgaacattgctattacaagaattgcaaacccttatggacatcctaatattcttgcagaatttatagccgggcaattaaggaatagagtttcgtttcgtaaagcaatgaaaaaagctattgaattaactcaacaggcggggacaaaaggaattcaagtacaaattgcgggacgtatcgacggaaaagaaattgcacgtgtcgaatggatcagagagggtagagttcctctacaaaccattcgagctaaaattgattattgttcctatacagttcgaactatttatggcgtattagggatcaaagtttggatatttgtaaacaaagaataatccaattctccttttctttttctttaaggttccttgtttcggtaaaacaaaaaatgataattttccaaattttataagattgaataaaaaatatcaattaattttttatataaatataattgctatgcttagtgtgtgactcgttgattttttagagtggttagagttcgacaataaaataaatgacttataggatgaattcattaataactaagtactaaccaactcatcgcttcgcattatctggatttaaagaattaatctaaaaatcgaaataaaatcaagatatcatattttggtagtagaattataacaactgagatattggataaaaaaaataaaaacgaatctgattataagttgtaaagcaataagaatatacagataaaaatgaagggtgaaagaaagaaaaaagatatatcaatgatatagaattcgaatatgtaaaggtcttatggttatctcataaaaaggggaagtgtaataaagcatcaacattaactaaatccatatatagatatatatat

SEQ ID NO: 9133 - DNA, 3635 bp, Vinca minor
attcactatgtacgaggatccccgctaagcatccatggctgaatggttaaagcgcccaactcataattggcgaattcgtaggttcaattcctactggatgcacgccaatgggaccctccaataagtctattggaattggctctgtatcaatggaatctcatcatccatacataacgaattggtgtggtatattcatatcataatatatgaacagtaagaactagcattcttattgagactagaactcatagggaagaaaatagatttatggatggaatcaaatatgcagtatttacagacaaaagtattcggttattggggaaaaatcaatatacttttaatgtcgaatcgggatcaactaggacagaaataaagcattgggtcgaactcttctttggtgtcaaggtaatagctatgaatagtcatcgacttccgggaaagggtagaagaatgggacctattatgggacatacaatgcattacagacgtatgatcattacgcttcaaccgggttattctattccacctcttagaaagaaaagaacttaaatcaaaatacttaatagcatggcgatacatttatacaaaacttctaccccgagcacacgcaatggaaccgtagacagtcaagtgaaatccaatccacgaaataatttgatctatggacagcatcgttgtgggaaaggtcgtaatgccagaggaatcattaccgcagggcatagagggggaggtcataagcgtctataccgtaaaatcgattttcgacggaatgaaaaagacatatatggtagaatcgtaaccatagaatacgaccctaatcgaaatgcatacatttgtctcatacactatggggatggtgagaagagatatattttacatcccagaggggctataattggagataccattgtttctggtacagaagttcctataaaaatgggaaatgccctacctttgagtgcggtttgaactattgatttacgtaattggaagtaaccaattaggtttacgacgaaacctagaaatcgatcactgatccaatttgagtacctctacaggatagacctcaacagaaaactgaagagtaacggcagcaagtgattgagttcagtagttcctcatataaaattattgactctagagatatagtaatatggagaagacacaattgtttcaagcaccgacagaaccggaagcgccccttctttcaaagagaggaggacgggttattcacatttcatttgatggtcagaggcgaattgaaagctaagcagtggtaattctaaagattcccggggggaaaaatagagaggtctcctacgttacccataatatgtggaagtatcgacgtaatttcatagagtcattcggtctgaatgctacatgaagaacataagccagatgacggaacgggaagacctaggatgtagaagatcataacatgagtcattcggttggattcatatatccacccatgggtcattgtacgatataagatccatctgtatagatatcatcatctacatccagaaagccgtatgctttgtaagaagcttgtacagtttgggaaggggttttgattgatcaaaaagaagaatctacttcaaccgatatgcccttaggcacggccatacataacatagaaatcacacttggaaagggtggacaattagctagagcagcgggtgctgtagcgaaactgattgcaaaagaggggaaatcggccacattaaaattaccttctggggaggtccgtttgatatccaaaaactgctcagcaacagtcggacaggtggggaatgttggggtgaaccagaaaagtttgggtagagccggatctaagcgttggctaggtaagcgtcctgtagtaagaggagtagttatgaaccctgtagaccatccccatgggggtggggaagggagagccccaattggtagaaaaaaacccacaaccccttggggttatcctgcacttggaagaagaagtagaaaaaggaataaatatagtgataatttgattcttcgtcgccgtagtaaataggagagaaaagcgaattgttttcttcggctttacaaaacaaaaagaaaaaataggagtaagctgtgacacgttcactaaaaaaaatccttttgtagccaaccatttattaaaaaaattgagaaacttaacacgggcgaacgacgggaattgaacccgcgcatggtggattcacaatccactgccttgatccacttggctacatccgcccccttccctatatttctaagattccaaattaaatataatattaattacaaataaaaaaaaagtatgatactcaaacctcagcaaactaaaagtcctttgctttctctctaatgaaaagaaagaagaaaaatttctagaaaatacgagaataaataaaaagaaaataaaggagcaataccaccctcttgatagaacacgaaggtgattattgctcctttatttttcaataactcctatacactaagaccgaggtcttagccattgatagatggagcttctatagcagctaggtctagagggaaattatgagcattacgttcatgcataacttccataccaaggttagcgcggttaatgatatcagcccaagtattaattacacgaccttgactatcaactacagattggttgaaattgaaaccatttaggttgaaagccatagtgctgatacctaaagcagtgaaccagatacctactacaggccaagcagctaggaagaagtgtaacgaacgagagttgttgaaactagcatattggaagatcaatcggccaaaataaccatgagcggctacgatattataagtttcttcctcttgaccgaatctgtaaccttcgttagcagattcattttctgtggtttccctgatcaaactagaagttaccaaggaaccatgcatagcactgaataaagagccgccgaataccccagctacgcctaacatgtgaaatgggtgcataaggatgttgtgctcagcctggaatacaatcatgaagttgaaagtaccagagattcctaaaggcataccatcagaaaaacttccttgaccgattgggtagatcaagaaaacagcggtagcagctgcaacaggagctgaatatgcaacagcaattccaaggtcgcatacccagacggaagctaagctcccactcacgacccatgtaacaagctacaccaagtaagaagtgtagaacaattagttcataaggaccgccgttatataaccattcatcaacggatgccgcttcccagattgggtaaaagtgcaaaccgatagctgcagaagtaggaataatggcacctgaaataatattgtttccgtaaagtaaagatccagaaacaggttcacgaataccatcaatatctactggaggagcagcaatgaaggcgataataaatacggaagttgcggtcaataaggtcgggatcatcaaaacaccaaaccatccaatgtaaagacggttttcagtgctagttatccagttacagaagcgaccccataggctttcgctttcgcgtctctctaaaattgcagtcatggtaaaatcttggtttatttaatcatcagggactcccaagcgcacacattctctatttctatttataaag

SEQ ID NO: 9134 - DNA, 10033 bp, Gossypium raimondii
atggggagtccgctttgaaatcgttcgccctgcacccacccccgagtatatgcttcaacaggaatcacgcacacaagggtagattgatacaatataaacctctggtaaaatgccccccccgtaacccagcggataaagtacattacatagtccgttttagggattggcgacttacccattccgtgactttggcactggacgttccaaaaatgggtactatcgggtcgggtgaattcaataatagacgcctggtggcattccagctttccttctcctttcaggacctatccgaaagagaatccagtacttctcggtcgtgaatatctgaatagggcgaaccgccccgtggatatctttgcttcggaacaaaacaattagaatagaattaggctcggtcaactggaatgtgtattatccatatattatccatataggggatcctccagttgagaagatccatcgacctgagacgaagagaaaggtctatctattttatttagttattcagttaaaccaatgattcgttattggagcagatagcaacaaccatttcatccgacatgcgtatttttgattttccaatggatttacatctttcattaatggaaattttttgatgtagtgagtaatagctctggttgttcgctgttcaagaattcttgtttaggcagttcataccatccatacatagtgttttgatctaagatttcaattcttccatgtttcagcagtagcatattgtttcatggagctaaggtccaaaatatggaagaaacaggtgtttccacaactctaccacccagtccgttccacttaatccctatttcatgaccacatatctttccggctaagtaatgggaaacctttctcctcttacatgaatccaattttcatttcatccgggaaaagccatctttttctcaacaatgtctttgtcatttgatccaatagccttccgttagataggaacagatttgataaatactgataactctcggatggagtattagaacggaaaaatccattagataatgaactattggttctaagccatctctggcgatgaatcaataattcgaagtgcttttcttgcgtattcttgataaaccagcgtttatatatagatgtaggaggatctgtttgggaagtaagaagcccctttgacatctcttcatctgcaaagaattctcggtgtgaaaacacagagacaaagggctgatctttgaataggaaaaagagtggatccgcaggatcccaaatgaattggcttattcgaaaaaagccttgttctttggaagatctatctcgtgcctggtactgcatggttccactctgcaagaacgccgaatcattctcttgaagctcatccttttcatcataaatgatccgcttgccccgaaatgacccggcccaatagggaaatcccaattcatttggcctttcgatacaatcaaatagaaagccccaagggcgccatatcctaggagcccaaactatgtgattgaataaatcctcctctatctgttgcgggtcgagtactccttctccttccccttcttcaaactccgattcgtatttttcatagagatttctctgatcaacgatagaacaagatccattttgcatcatatataagggattccccggctcggaccgaagaagcaatgtcactcgatcattatcaaactgaccgcaatctttttctgtccgtgaggatcccaccagagcgccttctacttctaataggccatgaactagatcagaatcattctcaacgaacccataagaagtgatcccatttttttcatcgggtccgggtagagaccaaaggtcttgagcgaccgatccggcagaacaactcaaaagataaagaagtatcgttaatttcttcatgctcgttccaagctcgaagtaccatttgtacaaataagaatccccttcgttacatgatttcttcttcatatagatagatataggatctaaggggcaattacttagaagtacattttgtacaacagcccttcctatctgatagaaaaggatcccatgatcctgaaccgatcttacctgggatcgcaaatcccaagtttgtctatgaagagcagatctaattgtattagtgtctataattgatttcttctgtgtaatactaatcgatagggcctcattggtaagtgctacaagatctcgtgcattggaacccacggttatggacccgaatccattagtatggaacattttcttttccaagtgaaatcccctagtatatgaaagagtgaaaaagtgctttcgttgttgtggaataagaagccttcgtatcttaatacatgtatttaatttattcggggctattagagtgggatccactttttggggaatatgagtcgaagcaataacaagaatatttctagtggaacatctttcacaatccttggagagatagttcactaatagaccgagggataagtaattcgcctcattcacatccagatcatgaatgtttggaatccatattatgcaaggagacattgcttttgctagttcgaattgaagggtgatataaaatcggtctatttccgacatcatatccatagttaacgcattcatcatagttagaagctccagctccgtatcaaggtcacgatcaatagcgtcactatcatcaatagcgtcactagcatcaatatcgtcactagcatcaatatcgtcactatcatcaatatcgatatcatcaataagaaaacctttaagcttgttatccaggaacttgttcagaaatactgtaatgaaaggaacataggagtttgtcgctaggtatttgaacaaataggatcgtccggttcctatagaacctatcactaaaatacccctagagggagatagggctaagcggagcgaaaagggttttccacgagacgggaaatgaaaactattagccccacacgaagtttgtgaataagtgattgtctgataatgagcaaggaatatccgcctttctgctaaacaggatgtattgaactcataattcattagatactttttatgaatgtcaactaagtatcgtaagtaaattggtcccggttgttcaatcatttgataaccagagtcattctttgataaatgatcactatgagtcagactcaatagaatttgatcaatccttttttctgtcgttaaggtggagaactgaaccaagaattctctttctttatcatcaatcgaatcactgttcgcgacccaggattctattttctcatcaatccaatcaccgctcacgttttttctttttcttatcaatgaatagatctctttacttgtatgacttagatgtctcgtatttctcgaaaaaatgattcgattgatgggatttggtatgatacttatgagatcgatgatatcgatgagattgatattcaaatatttcttcttagaacgtattgatttgaccccataagcgggaccaccaccccatagcatgttgccgccaaaagcagaaccccgtatttcttctagagaatctcctaattgttccagagcaactagaaagagattctttaaccagaaagaattcagttcagatgtaggatacctatccagaagttttcgcaactcaatcatgtatgatggaatcatcaaagatttgaccttttcgaactctgtctgtaactcactataggctcgggaaacaaagagaagatgtgtacgaacgagatatccagcaacaagaagaaggaaaaggattgaatagaggaactcctgaacatttggcgatctcagatgtgtcgatatcaatggtgactcattatttcgatgaatcatttcttcggacagaagaaaattatgtaaacacttactcgaaatctcacttatcagattccattgtggaagacacaattttttctgaagaattcgccatgatatatctgatccatgcataatatcatgaaaaatggatacacatttttgactgctacttagtatcggcaataggtctgaaaaagtatctaaaaatatcaaatttagatatttgtaccctgtcgaagtaaggaaccatggcatatatgtttggaatagattccgttttgagagagttgaaaaagcactatctcgttgaaaggttctatacatccaccctttctcaacgcatttctttagacaaagactccgttttttccgcttttcggatggtaaatatttctcagaacatggagtgtgaatcaaacccatgtttgaattgaaattgagatactgatgcaagttcttctcttctgaatcagatggattcatatctgaaagaggttgacaataagttctttcaaaattgactatttgtccctctgttagaggtgttccagaaatgtctgcaatcgagtaaatagctctacgaactaatggatcggatcgaattgcaaactggaaagatttgtacaagttatacctttcgtcaccactttgtggaaaatcattagatatgaatatgttagatacctgcgactcgattggtgaaggtgaaatagtatctctccccaaaaaagcatgtttttttttaccaccgcacaaagaaaatattttgttgcgaatgaacaagatattgaggaattgtccatacgtaaaatcataattattgatacgggccttttccacataaaaagggaatcttttgttacaatagaagcagaagtgatgtggattattcaagaatcgaagtcgatttgctttataaaaagaagatatcaatgaacttctatgaaatggtttcacgggattcagccaattgtcttgatcgtgggatatcattgagaaataggaatccatgttatcaaaagatttcctgcgattatttctagtatggaatgagtcaatcatccactttggtatcttattgaccaaaaatggtgatattgttcctccattgatcaagaatttcggtttttgagaagtattatgatcatccaataagaaaggtttcaattttttcaaatgaacgatttgaagacctattgattctaacaactgattgcaaagttgatcattcggacctttcaattcatagatgtggatctcagacctatgaatggggatattcccgaaactcacaaagaaaaaaggaagtgagttagacaaaaagagaagcaacttggacaaaaagagaagtaacttggacaaaaagaaacgaagtgacttagacaaatcttttttgtcgataacctcagaccaatcaatcgaatattgattaatacgtaatcgatcgaacactacttgaaaacggctcttctgctcagaaacgaaatgttccaaatgctcctggaaattcttgctcccattggaccatttgtatctatatgcattaggatcccgattcatggatctctcggtccgagaaatcaaaataagaggatcgaaccatttcttctgactctttttcaaattcgataaatgttggttgatcgtatatttcattatagttctatgattcagagtatcatttcctatttgatccctttgaattccatattcgaagttgcgatcggatcgattctttttaatgaatcgattcaatccatttcttatgtacccataggtgctatattggatttgaatcagatttcggatcaatctatcttgattgactgcctccattatgttgttgctagcaaataccactatttttggttttggatcttccaaatcattcccgcaggagatccggacccatttttttctgatccttcgataaaaagattcattttcttcataaaaaataggaggtagagccgataaagatttctttttcgattcatccctggagttgaatacctcattcaagaattgtttttgatccaatccgtaggaatcaatagaaaaggcaaatcccttataatacaccagatccggctcggttattgatagagtgaatagatctgccatttcttgaaatctctcttctgattcaaaatcgtggtgtaacgtgtatcccctcctgttctggtcatggaatagatgaaataaatcaaaaaatggatttttgttcaagaatgaaatcttattggaactgcccagttcatccttcggaaccatatcacatcccggatctgatgaaataggatgaattgagacggtattttgtaaatacgtaattatcttgaatatattaactatttctttattttccgatcgcctggaagggacaaaagaaacatcttgttctttcttcaacaatttctgatctctagtggacctctcagtagggttcgaacccagatgaagttctgaccatctatcagagaaaaaagaacgaatggatcttgtaggattcccaagaaattcttcgatttcttccggaagcagatgattattcatccgcttctcacgttccgtgaatagccgggacattgaggaatatccagaaaggcacttagggaatcggtctgattctatctccgttcgttccgtttgaagaaaggaaggatcccaaagaatcgatctttcttttagttgttgaatctctctttgattgatcaatgtgtgatattccgaatcctcattactaatggaatcgaaacgatctctggattgatcagaagatcctttcaattggcgagaatccgttacttgaacgaaactagatcttgtggaatcatattgaatatttgacgatacattccgtaccttgctaaaaaatcgatccctgtttaccaaccatacattgtctaaccaaatccaattctctctcgatatgttcctcaaaaaatccgattcgtgtggattcttcccccaactaacgaagagatcttggcggaattgccacatatgaaattgagcacaattttgcaaagaaatagcccacttgcctctcgagaagagatgggaaacatgctcaatatcatttgattgaatagttgacccagctccttgttgtttgaagaaaccctccacttcaattggtattttttcacgaaaagcaaacatgagataacaaatccagtctttcactaagatttcgaatagctgtcccgagttcaagttgattatgtttcgcctcttactcggagaaagacgatcaaacaattcccaatcatggtccttgcggatcgaatcatccatataatatacaaaaagaaactccagatatttgatatctttctctttgaatgagatctcaattccagcgacggtttcattagatatcttacaactagaatccctcttttttccgatccagttcctccacccccgcgaaccccggttagattcaggcatgatacactttttagttattgggagaacccaagtactctctttcggatccaggaaacagctctcagagatcttttttccttttggaagatacaggagcgaaacaatcaacctattgatattggaagacccaaaagattcttccaatgtatcatttctgggtccaatggaattcataggtataggaagaagccctgtcaaatagagattttttctttcgaccatatttcgattgttaatacgatatataaggaccgctactacaaatagtactacacccttgatcgtgaaatatcgattgcttgttgaaccctgtgaattgcgtgaaagtaggatactccaaattcgggggtccaagagttttataaaacgttcttggtggaaaaaaatgtgaatgaaagatcccactgaattgaattgggtccatgaatctaagaaatagtgagaattcttgatctctctcaatatctctctcaattcgaaaatccaggatttgaattgatgtcctttcattgattcctcctaaattgcattgatttatcctaaagatttcatttcaattggaatttggttattcaccatgtacgaggatccccgctaagcatccatggctgaatggttaaagcgcccaactcataattggcgaattcgtaggttcaattcctactggatgcacgccaatgggaccctccaataagtctattggaattggctctgtatcaatggaatctcatcatctatacataacgaattggtgtggtatattcatatcataacatatgaacagtaagaactagcattcttattgagactcgaactcatagggaagaaaatagatttatggatggaatcaaatatgtagtagttacagacaaaagtattcggttattggtgaaaaatcaatatacttctaatgtcgaatcaggatcaactaggacagaaataaagcattgggtcgaactcttctttggtgtcaaggtaatagctatgaatagtcatcgactccccggaaagggtagaagaatgggacctattatgggacatacaatgcattacaggcgtatgatcattacgcttcaaccgggttattctattccacctcttagaacgaaaagaacttaaatcaaaatacttaatagcatggcgatacatttatacaaaacttctaccccgggcacacgcaatggagccgtagacagtcaagtgaaatccaatccacgaaataatttgatctatggacagcatcgttgtggtaaaggtcgtaatgccagaggaatcattaccgcaaggcatagagggggaggtcataagcgtctataccgtaaaattgattttcgacgaaatgaaaaagacatatatggtagaatcgtaaccatagaatacgaccctaatcgaaatgcatacatttgtctcatacactatggggatggtgagaagagatatattttacatcccagaggggctataattggagataccattgtttctggtacagaagttcctataaaaatgggaaatgccctacctttgagtgcggtttgaactattgatttacgtaattggaaggaaccaattaggtttacgacgaaacctaaaaatcgatcactgatccaatttgagtacctctacaggatagacctcaacagaaaactgaagagtaacggcagcaagtgattgagttcagtagttcctcatataaaattattgactctagagatatagtaatatggagaagacaaaattgtttcaagcaccgacagaaccagaagcgccccttgtttcaaagagaggaggacgggttattcacatttcatttgatggtcagaggcgaattgaaagctaagcagtggtaattctaaagattccccgggggaaaaatagagatgtctcctacgttacccataatatgtggaagtatcgacgtaatttcatagagtcattcggtctgaatgctacatgaagaacataagccagatgacggaacgggaagacctaggatgtagaagatcataacatgagtggttcgacagatttggattcctatatatccactcatgtggtacttcattgtacaatatatataagaattatacgataagaattatacgaatccatctgtatagatatcatcatctacatccagaaagccgtatgctttggaagaagcttgtacagtttgggaaggggttttgattgatcgatcaaaaagaagaatctacttcaaccgatatgcccttaggcacggccatacataacatagaaatcacacttggaaggggtggacaattagctagagcagcgggtgctgttgcgaaactgattgcaaaggaggggaaatcggccacattaaaattaccttctggggaggtccgtttgatatccaaaaactgctcagcaacagtcggacaggtggggaatgttggggtgaaccagaaaagtttgggtagagccggatctaaatgttggctaggtaagcgtcctgtagtaagaggagtagttatgaaccctgtagaccatccccatgggggtggtgaagggagggctccaattggtagaaaaaaacccgcaaccccttggggttatcctgcacttggaagaagaagtagaaaaaggaataaatatagtgataatttgattcttcgtcgacggagtaaataggagagattatttctttcttcgtctttacaaaaacaaaaaaatatatttttaaagtaaaaaaaatggcgcgttcactaaaaaaaaatccttttgtagcaaatcatttattaaaaaaaat

SEQ ID NO: 9135 - DNA, 2151 bp, Sorghum bicolor
atagatagttcgaattggatagcagcaataatcaattttagcgcgaattgtttggaggggtagtctaccctttttgatgcattcggcacgtgcaatttcttttcctgctagacgacccgcaatttggatttttattccctttatatccgcttttttagttaattcaatagcttttttcattgcttttcggaatgaaactctattttttaattggaaagctatatattccgcaagaatattaggttgtctataaggttctttaaccttttcaatagcaatattaagtctctggtttacagaattaacttccttttggagatctttctctaattcttcgattgctccctttttctttaataaattggggaatccaatatggattatgacgtggattgtatcgatttctttttgaatttctatatgtgtaattacttcagaacttgagtctgattccatttttctattcgagccttttttcctattcttttgtatatagttcttgatacaattccgtatttttttatcttcctgtagaccttcagaataattttttggttgtgcgaaccaaaaggaatggtgattttgggttgtaccaagtctgaaaccgagtggatttattttttgtcccatatttttctattatatttcttttttttactgggaatcgaaattttagattgatctaaagattatttagatttctttactatatttagtacaattgttatattacacatcgttttttttatagaataactacgtcctcgagctcgaggtctgaattttttcataatagtactcctactgacttcggctttagtgatgaataaattcgttttgtcgaaatccctataatgagtagcatttgctgctgccgaataaaccaactttaagatgggatacgatgctcgataaggcatgagattcagtatcataacggtttcctcgtagtaacgccagcgaatctcatctagaactctttgtgctttgaaaacagacatatgtatgcgtttttgtgctttgaaaacccgttcgaatttaagtagacgatcggttggaacttttcttgcgagttttctcagccccttcttcttctttatcctaggggtatactttaccaatttgaaacttgtcataaataaggttattacccgcctatctttattttatttgattatttgaatcctataaattttgtttattctgaatctttctattctgaattcaattaacgacgagatttagtatcctttcttgtactttcataactcgtgaaatgccgagtaggcacgaattcccccaatttgcgacctaccataggatttgttatgtaaataggtatatgttcttttccattatgaatcgcgattgtatggccaaccattgcgggtagaatgctagatgcccgggaccacgttactattatttctttctcctccttcatattgaccttttcgatttttgccaataaatgacgagctacaaaaggattcgttttttttcgtgtcacagctgattactcctttttttcattttaaagagtggcatcctatgtccactatctcgatcgaggtatgtaggtcagaataaatagaataataatgaatggaaaaaagagaaaatcctttagctggataaggggcggatgtagccaagtggatcaaggcagtggattgtgaatccaccatgcgcgggttcaattcccgtcgttcgcccatcgcattattgcaatttccaaaaatgcaattttccatattcctagttacgtatttacttacggcgacgaagaataaaactatcactatattttttccttttcctagttcttcttccaagcgcaggataaccccaaggggttgtgggtttttttctaccaatgggggctttcccttcaccacccccatgggggtggtccacagggttcataactacccctcttactacggggcgtttacctaaccaacacttagatccggctctacccaaacttttttggttcaccccaacattacccacttgtccgactgttgctaagcagttttgggataccaaacggacctccccagatggtaatcttaaagtgccaatttaccctctttgcaatcagtttcgctacagcacctgctgctctagctaattgcccaccccttc

SEQ ID NO: 9136 - DNA, 2395 bp, Persea americana
ccgtaatatgtggaagtagcgacgtaatttcatagagtcattcggtctgaatgctacatgaagaacataagccagatgacgaaacggagagacctaggatgtataagatcataacatgagtgatttggcagatttgtattcctatatatccactcatgtggtacttcatcacacgattcatataaaatccatctgtctagatatcatcatataatatatatatatacatccggaaagccgtatgctttggaagaagcttgtacggtttgggaaggggtttttattgatcaaaaagaaaaatctacttcaacccatatgcccttaggcacggccgtacataacatagaaatcacgcttggaaagggtggacaattagctagagcagcaggtgctgtagcgaaactgattgcaaaagagggtaaatcggtcacattaagatttccatctggggaggtccgtttgatatccaaaaactgctcagcaacagtcggacaagtgggtaatgttggggcgaaccagaaaagtttgggtagagccggatctaagtgttggctaggtaggcgtcctatagtaagaggggtagttatgaaccctgtagaccatccccacgggggtggtgaagggagggccccgattggtagaaaaaaacccacaaccccttggggttatcctgcgcttggaagaagaagtaggaaaaggaataaatatagtaatagttttattattcgtcgccgtaaataggaatattcaaaatcaaataaatattgttttttactcgtcttttcaaaaaaaaagggggggggaataataggccgtgacacgttcactaaaaaaaaatccttttgtagctaatcatttattggaaaaaataaagaagcttaacatgagagaggaaaaagagataatagtaacttggtcccgggcatctaccattatacccacaatgatcggcaatacaattgccattcataatggaaaggcgcatttacctatttatataacggatcgtatggtgggtcaaaaattaggagaatttgcacctactcttactttccagggacacgcgagaaacgatactagatctctccgttaataaaataaagtgaaataggtgctcatcgttcattggcgggaggcgaaccttatcttatgtcaaagtggagaaagtggaagaagaccttgaaaaagcagaagatgaagaggagctcgagtacacaagtacaagctttagctcaacgtatatgtatgtctgctcacaaagcacgaagagtcattgatcagattcgtgggcattcctacgagaaaacacttatgttactggaactcatgccttatcgagcattttatcccatttttaaactggtttattctgcagcagcaaatgctagtcacaataaaagtttcaacgaagctgatttagtcattagtaaagccgaagtcaatgggggtactatcgtgaaaaagttaaaacccagggctagaggacgtagttatccgatagaaagacccgcctgtcatataattattgtattgaaggatagctctaaaaagaaaacagatcaggatatatttttagaaacaaaaaatgtatggagagatcctataatagaaagatatatagagaaggagagagagagagaaaaaaaagatgggtcaaaaaataaatccacttggtttccgccttggcgaaaaccaaagtcatcgttccctttggttcgcacaaccaaaaagttattacataggtctccaggaagatgaaaaaatacgggattgtatcaagatatatgtacaaaaaaatataagagtatcttcaagtttcgaaggaattggaattgcacatatagagattcaaaaaaaaatggacttgatccaggtcataatctatattggattcccaaatttgttaatagaaggccaaacacgaggaatcgaagaattgcagatcaatgtacaaaaggggcttcattctgtgaatcggagacttaacattgctattacaagagttgcaaaaccttatggacaacctaatattcttgcagaatatatagctctacaattaaagaatagggtttcgtttcgaaaggcaatgaaaaaagctattgaattaactgaacaagcagacacaaaaggaattcaagtggaaattgcagggcgtatcgacggaaaagaaattgcacgtgtcgaatggatcagagaaggtagggttcccctccaaaccattcgagctaaaattgattattgttcctatacagttcgaactgcctatggggcattgggcatcaaaatttggatatttgtagacgagcaataatggacccttcctttgcttgccattctattcagtgatagaacaaaaactacaaactattccttttcacttcaataaaaaaaaaaa

SEQ ID NO: 9137 - DNA, 9629 bp, Phaseolus coccineus
ataaatgattcgctacaaaaggatttttttttagtgaacgcgtcacagttaattactcctttttcttgtaaagacgaagaaacaatttctattttctctactatttagtacgacgacgaagaatcaaattatcactatatttcttcctttttctacttcttcttccaagtgcaggaaaaccccaaggagttgcgggtttttttctaccaattggggccctcccttcaccacccccatgcggatggtctacagggttcataactactcctcttactataggacgtttacctagccaacatttagatccggctctacctaaatttttctggtttaccccaacatttcccacttgtccaactgttgccgagcagtttttggatatcaaacggacctccccagaaggtaattttaatgtggccgatttcccctcttttgcaattagtttcgctacagcaccagctgctctagctaattgtccaccctttccgagtgtgatttctatgttatgtatggccgtgcctaagggcatatcggttgaagtagattcttctttttgatcaataaaaacctcttcccaaactgtacaagcttcttacaaagcatacggctttctggatgtagatgatgatatctatacagatggatcttctatatatcgcacaatgaagtaccgcacgagtgggtatataggaatccaaatctgccgctcatgttatgatcttctacatcctaggtcttcccgttccttcatctggcttatgttcttcatgtagcattcagactgaatgactctatgaaattacgtcgctacttccacatggtacgggtaacgtaggagacatctctctttttcccagggggaatccttagaattaccacagcttagctttcaattcgcctctgaccatcaaatgaaatgtgaataacccgccctcccctgtttgaaacaaagggtgcttccggttctgtcggtgcttgaaacaattttgtcttctccatattactatatctcgagagtcaataattttatatgaggaactactgaactcaatcacttgctgccgttactcttcagttttctgttgaggtctatcctgtagaggtactccaattggatcagtgatcgatttctaggtttcgccgtaaacctagttggttacttccaattacgtaaatcaatagttcaaaccgcactcaaaggtagggcatttcccatttttataggaacttctgtaccagaaacaatggtatctccaattatagcccctctggggtgtaaaatatattttttctcaccatccccatagtgtatgagacaaatggatgcatttcgattagggtcatattctatggttacgattctaccatatatgtttttttcattccgtcgaaaatcaatttgacggtatagacgcttatgacctccccctctatgccctgcggtaattattcctctggcattacggcctttaccacaacgatgctgtccatagatcaaatgatttcgtggattggattttacttgactgtctacggctccattgcgtgtgcttggggtagaagttttgtataaatgtatcgccatgctattaagtattttgatttaagttcttttctttctaagaggtggaatagaataacccggttgaagcgtaatgattatacgtctgtaatgcattgtatgtcccataataggtcgtactcttctaccctttaccgggagtcgatgactattcatagctattactttgacatcaaagaagagttcgacccaatgctttatttctgtcctagttgatcccgattcgacattaaaagtatattgatttttccccaataaccgaatacttttgtctgtaaatactgcatattttattccattcataaatatattttcttccctatgagttctagtctcaattaaaatactagtttttactgttcatatgttatgatttgaatataccacatcaattcgttatgtatggatgatgagattccattgatacagagccactcgttcttttttctctgacagatggtcagaacttcatctgggttcgaatcctactgataggtctactagagatcagaaattgttgaaaaaagaacaaaagaaacatcttgctctttccaggcgatcggaaaagaaagaaatagtgaatttattcaagataattatgtacttacaaaataccgtctcaattcatcctatttcatcctatcgaggatgtgatatggttccaaaggatgaattggacagttccaataagatttcattcttgaacaaaaatccgatagactttttggagggagggtcccattggcgtgcatccagtaggaattgaacctacgaattcgccaattatgagttgggcgctttaaccattcagccatggatgcttagcgggaatcctcgtacatggtgaataaccaaattccaattgaagtgaaatctttcggataaatcaatgcaattaggaggattcgatgaaaggacatcaattcaaatcctggattttcgaattgagagagatattgaaagaaatcaagaattctcgctatttcttagattcatggacccaattcaattcagcgggatttctcattcatatttttttccatcaagagagttttataaaactcttggactcccgaatttggagtatcctactttcacgcaattcacagggttcaacaagcaatcgatatttcacgatcaagtatgtagtactctttgtagtagcggtccttatatatcgtattaacaatcgaaaaatggtcgaaagaaaaaatccctatttgacaaggcttcttcctatacctatgaattccattggacccaaaaatgatacattggaagaatcatctgagtcttccaatatcaataggttgattgttccgctcctgtatcttccaaaaggaaaaaagatctctgagagttctttcctggatccgaaagagagtactcgggttctcccaataactaaaaagtatatcatgcctgaatttaactggggttcgcggtggtggaggaactggataggaaaaaagagctattctagtttaacggattctagccaattgaaaggatcttctgatcaatccaaggattctttcgattccattaggaatgaggattcgaaatatcacacattgatcaatcaaagagagattcaacaactaaaagaaagatcgattctttgttgggatccttcctttcttcaaacggaacgaacagagatagaatcagagcgattccttaaaaacctttctggatattcctcaatgtgccgactattcatggaacgtgagaagcagatgaataatcatctgcttccggaagaaatcgaagaatttcttgggaatcctgcaagagccactcgttcttttttctctgacagatggtcagaacttcatctgggttcgaatcctactgataggtctactagagatcagaaattgttgaaaaaagaacaaaagaaacatcttgctctttccaggcgatcggaaaagaaagaaatagtgaatttattcaagataattatgtacttacaaaataccgtctcaattcatcctatttcatcctatcgaggatgtgatatggttccaaaggatgaattggacagttccaataagatttcattcttgaacaaaaatccattttggggtttctttcatctattccatgaccggaacagggggagatacacgttacaccacgattttgaatcagaagatctatttcaagaaatggcagatctattcactctatcaataaccgagccggatctggtgtatcataaggaatttgatttttctattgattcctccggattggatcaaaaacatttcttgaatgagttattgaactccagggatgaatcgaaaaagcactctttattggttctacctcctcttttttatgaacagaatgaatctttttatcgaaggatcataaaaaaatgggtccagacctcttgcgggaataatttggaagatccaaaacctaaaatagttgtatttgctagcaacaacataatggaggcagtcaatcaatatagattgatccgaaatctgattcaaatccaatatagcacccatgtttacataagaaatgtattgaatcgattcaattgcaacttcgaatatggaattcaaaggtatcaaataggaaatgatactctgaatcatcgaactagaatgaaatacacgatcaaccaacatttctcaaatttgaaaaagagtcagaagaaatggttcgatcctcttattttgatttctcgaacggagagatctatgaattgggatcctaatgcatatagatacaaatggtccaatgggagcaagaatttccaggaacatttggactatttcatttctgagcagaatagccttcaagtagtgttcgatcgattacatattaatcaatattcgattgattggtctgaggttatcgacaaaaaagatttgtctaagtcactttgtttatttttgtccaagttacttctttttttgcccaagtttcttctctttttgtctaactcacttccttcttttttctttgtgagttttgggggtatctccattcataggtccgagatccacatctatgaattgaaaggtccgaatgatccactctgtaatcagttattagaatcaataggtcttcaaatctttcatttgaaaaaaaggaaacccttattattggatgaccaagatacttcccaaaaatcgaaattcttgatcaatggaggaacaatatcaccatttttgttcaataagataccaaagtggatgattgactcattccatactagaaagaatcgcaggaaatcttttgataacacagattcctatttctcaatgatatcccacgatccagacaattggctgaatcccgtgaaaccatttcatagaagttcattgatatactatttttataaagcaaatcaacttcgattcttgaataatcaatatcacttctgcttctattgtaacaaaagattccctttttatgtggaaaaggcccgtatcaataattatgattttacgtatggacaattcctcaaaatcttgttcattcgcaacaaaatcttttctttttgcgatggtcaaaaaaaacatgcttttttgaagagagatactatttcaccaatcgagttacaggtatctaacatattgatacctaacgattttccgcaaagtggcgacgaagggtataacttctacaaatctttccattttccaattcgatacgatccattcgttcgtggagctatttactcgatcgcagacatttctggaacacctctaacagagggacaaatagtccattttgaaaaaacttattgtcaacctctttcagatatgaatatacctgattcagaagggaagaacttgtatcagtatctcaatttcaattcaaacatgggttggattcacactccatgttctgagaaatatttaccatccgaaaaaaggaaaaaacggagttcttgtctacaaaaatgccttgagaaaggtcagatgtatagaacctttcaacaagatagtgttttttcaactctctcaaaatggaatctattccaaacatatataccatggttccttacctcgacggggtacaaatatctaaatttcatatttttagatactttttcagacctattgccgatactaagtagcagccaaaaatttgtatccatttttcatgatattatgcatgggtcagatatattatggcgaattcgtcagattccattgtgtcttccacaatggaatctgataagtgagattccgggtaattgtttccataatcttcttctgtccgaagaaatgactcatcgaaataatgagttactattgatatcgacacatctgagatcgctaaatgttcaggagttcttctattcaatccttttccttctccttgttgctggatatctcgttcgtacacatcttctctttgtttctcgagtctatagtgagttacagacagagttcgaaaaggtaaaatctttgatgattccatcatacatgattgagttgcgaaaacttctggataggtatcctacatctgaactgaattctttctggttaaagaatctctttctagttgctctggaacaattaggagattctctagaagaaatacggagttttgcttttggtggcaacatgctatggggtggtggtcccgcttatggggtcaaatccatacgttctaagaataaatcttggaatctcatcgatctcataagtattataccaaatcccatcaatcgaatcgctttttcgagaaatacgagacatctaagtcatccaagtaaagcaatctattccttgataagaaaaataaaaaacgtgaatggtgattggattgatgatcaaatagaatcctgggtctcgaacactgattcgattgatgataaagaaaaagaattcttggttcagttttctaccttaacaacagaaaaaaggattgatcaaattctattgagtcttactcatagtgatcttttatcaaagaataactctggttatcaaataagtgaacaaccgggagcaatttacttacgatacttagttgacattcataaaaagtatctaatgatttatgaattcaatacatcctgtttagtagaaagacatatattccttgctaattatcagacaattacttattcacaaaccttgtggggggctaatagttttcatttcccatctcatggaaaacccttttcgctccgcttagccctacctccccctagtaggggtattttagtgataggttctataggaactggacgatcctatttggtcaaatacctagcgaaaaactcctatgttcctttcattacagtatttctgaacaagttcctggataacaagcctaagggttttcttattgatgatagtgacgatattgatgatagtgacgatagtgacgatatcgaccgtgaccttgatatagagctggagcttctaactatgatgaatacgctaactatggatatgatgccagaaatagaccgattttatatcacctttcacttcgaattagcaaaagcaatgtctccttgcataatatggattcctaacattcatgatctggatgtgaatgagtcgaattacttatccctcggtcttttagtgaactatctctccagggattgtgaaagatgttccactagaaatattcttgttattgcttcgactcatattccccaaaaagtagatccagctctaatagctccgaatcaattcaatacatgcattaagatacgaaggcttcttattccacaacaacgaaaacactttttcactctttcatatactaggggatttcacttggaaaagaaaatgtcccatactaatggattcgggtccacaacgatgggttcaaatgtacgagatcttgtagcacttaacaatgaggccctatcgattagtattatacaaaaaaaatccatcatagacactaatataattagctctgttcttcatagacaaacttgggatttccgatctcaggtaagatcggttcaggatcatgggatccttttctatcagataggaagggctgtttcacaaaatgtacttctaagtaattgctccatagatcctatctctatctatatgaagaagaaatcatgtgacgggggggattcttatttgtacaaatggtacttcgaacttggaacgagtatgaagaaattaacgatacttctttaccttttgagttgttctgccggatcggtcgctcaagacctttggtctctacccggacctgatgaaaaaaatgggatcacatcttatggactcgttgagaataattctgatctagttcatggcctattagaagtagaaggcgctctggtgggatcctcacgtacagaaaaagattgcagtcagtttgataaggatcgagtgacattgcttcttcggtccgaaccaaggaatcccttaaataggattcaaaatggatcttattctatcgttgatcagagatttctctatgaaaaatatgaatcggagtttgaagaacggggaggagtcctcgacccgcaacagatagaggaggattttttcaatcacatcgtttgggctcctagaatatggcgcccttggggctttctatttgattgtattgaaaggcccaattcattgggatttccctattgggccaggtcatttcgggacaagcggatcatttatgatgaagaggatgagcttcaagagaatgattcagagttcttgcagggtggaaccatgcagtaccagacacgagatagatcttccaaagaacagggcttttttcgaataagccaattcatttgggaccccgcggatccactctttttcctattcaaagatcagccttttgtctctgtgttttcacatcgacaattctttacagatgaagagatgtcaagggaacttcttacttcccaaacagatcttcctacatctatatataaacactggtttatcaagaatacgcaagaaaagcattttgaattgttgattcattgccagagatggcttagaatcaatagttcatcatctaaaggatttttcccttctaatactctatctgagagttatcaatatttatcaaatctgttcctatctaacgaagcgctattggatcaaatgacaaagacattgttgagaaaaagatggcttttcccagatgagatagttgttgctatctgctccaataacgaatcattggtttcactgaatcactcaaaaaaaaaaaatagatagacctttctttctcttcgtctcaggtcgatggatcttctcaattgaaagatcccctatatcgataatacacattccagttgaccgagcctaattcgaattgttttgttccgaagcaaagagatccacggggcggtttgtcctattcagatattcacaaccaagaagtattgaattttctttttttttttttttcggataggccctgaaaggagaagaaaggttggaatgccaacaggcgtctatattttgaattcacccgacccgaaagtacactatccattttgggaacgtccggtgccaaagtcattgaatgggtaagtcgccaattcctaaaacgaactatttcatgtactttatccgcccgctgggctacgagtgggtattttcccagaggtttttattgtatcaatctacccctgtgtgattcttgttgaagcatatactcctcggggagggtagggtgcagggcggacgatttcaaaacagattacccattcattagatagagaagatcaccaagatttcgtgattcgctgtcgaacttattccaattcaataagagatctcaatattatgccttgaagaggactcgaacctccacgctctttagcacgagattttgagtctcgcgtgtctaccatttcaccaccaaggcatcttgaaagtgaatcgtattccatgaatatgatatctatttagtttgatgtatggaatatatgacaaaggtagagtgttagagtctttttattgattggtcatgtcatataggtccgagtcggacatccaattggttcgatttgaattatccagaggatatcttatctatctatatagatagatatagatagatattc

SEQ ID NO: 9138 - DNA, 884 bp, Ipomoea batatas
cccccctcgaggaaagaatttgatctatggacagcatcgttgtggtaaaggtcgtaatgccagaggaatcattaccgcaaggcatagagggggaggtcataagcgtctataccgtaaaatagattttcgacggaatgaaaaagacatatatggtcgaatcgtaaccatagaatacgaccctaatcgaaatgcatacatttgtctcatacactatgggaatggtgagaagagatatattttacatcccaggggggctataattggagatagcattgtttctggtacagaggtttctataaaaattggaaatgccctacctttgaccgaaatgcccttaggcacggctatacataacatagaaatcacacttggaaagggtggacaattagctagagcagcgggtgctgttgcgaaactgattgcaaaagagggaaaatcagccacaataaaattaccttctggggaggtccgtttgatatccaaaaactgctcagcaacagtcggacaagtggggaatgttggggtgaaccagaaaagtttgggtagagccggagctaaacgttggctaggtaagcgtcctgtagtaagaggagtagttatgaaccctgtagaccatccccatggaggtggtgaagggagagccccaattggtagaaaaaaacccacaaccccttggggttatcctgcacttggaagaagaagtagaaaaagaaataaatatagtgagaagttcattcttcggcgccgtagtaagtagtaaagaaaatcgaattgatttcttcaaaaaaaatatataggagtcagctgtggcacgttcactaaaaaaaaaatccctttgtagcgaatcatttattaaaaaaaattgataagcttaacagaaaagc

SEQ ID NO: 9139 - DNA, 598 bp, Lotus japonicus
tacgaccctaatcgaaatgcatacattgtctcatacactatggggatggtgagaaaagaatattttacaccccaggagggcttataatgtggagataccattgtttctggtacagaagttcctataaaaatgggaaatgccctacctttgaaatctacttcaaccgatatgcccttaggcacggccatacataacatagaaatcacattcggaaagggtggaaaattagctagagcagcaggtgctgtagcgaaactgattgcaaaagaggggaaatcggcaacattaaaattaccttctggggaggtccgtttgatatccaaaaactgctcagcaacagtcggacaagtaggaaatgttggggtaaaccagaaaagtttgggcagggccggatcgaaatgttggctaggtaagcgtcctgtagtaagaggagtggttatgaaccctgtagaccacccccatggggggggtgaagggagggcccccattggtagaaaaaaacccgtaactccttggggttatcctgcacttggaagaagaagtagaaaaaggaagaaatatagtgataatttgattcttcgtcgccgtactaaatagt

SEQ ID NO: 9140 - DNA, 784 bp, Medicago truncatula
cacgaaatcgtttgatttatggacagcatcattgtggtaaaggccgtaatgccagaggaatcattaccgcagggcatagagggggaggtcataagcgtctataccgtaaaattgattttcgacgtaatgaaaaagacatatatggtcgaatcgtaactatcgaatacgaccctaatagaaatgcacacatttgtctcatacactatggggatggtgagaaaagatatattttacaccccagaggggctataattggagataccattgtttatggtacagaagttcctataaaaatgggaaatgccctacctttgaaatctacttcaaccgatatgcccttaggcacggccatacataacatagaaataacacttggaaagggtggacaattagctagagcgcctggtgctgtagcgaaactgattgcaaaagaggggaaatcggcaacattaaaattaccttctggagaggtccgtttgatatcaaaaaactgctcagcaacagtaggacaagtagggaatgttggagtaaaccaaaaaagtttgggcagagccggagctaaacgttggttaggtaagcgtcctgtagtaagaggagtagttatgaaccctgtagaccatccacatggtggtggtgaagggagggccccgattggtagaaaaaaaccctcaactccttggggttatcctgcacttggaagaagaagtagaaaaaaaaaaaatatagtgataatttgattcttcgtcgccgtagtaaatagtctagagtagagaaaatagaattt

SEQ ID NO: 9141 - DNA, 511 bp, Nicotiana tabacum
aagaagaatctacttcaaccgatatgcccttaggcacggccatacataacatagaaatcacacttggaaagggtggacaattagctagagcagcgggtgctgtagcgaaactgattgcaaaagaggggaaatcggccacattaaaattaccttctggggaggtctgtttgatatccaaaaactgctcagcaacagtcggacaagtggggaatgttggggtgaaccagaaaagtttgggtagagccggatctaagcgttggctaggtaagcgtcctgtagtaagaggagttgttatgaaccctgtagaccatccccatgggggtggtgaagggagaaccccaattggtagaaaaaaacccacaaccccttggggttatcctgcacttggaagaagaagtagaaaaaggaataaatatagtgataatttgattcttcgtcgccgtagtaaataggagagaaaatcgaatttaatttcgtttttacagcggccgcatgaggggtacctgtcctc

SEQ ID NO: 9142 - DNA, 447 bp, Lotus japonicus
aatctacttcaaccgatatgcccttaggcacggccatacataacatagaaatcacattcggaaagggtggaaaattagctagagcagcaggtgctgtagcgaaactgattgcaaaagaggggaaatcggcaacattaaaattaccttctggggaggtccgtttgatatccaaaaactgctcagcaacagtcggacaagtaggaaatgttggggtaaaccagaaaagtttgggcagggccggatcgaaatgttggctaggtaagcgtcctgtagtaagaggagtggttatgaaccctgtagaccacccccatggggggggtgaagggagggcccccattggtagaaaaaaacccgtaactccttgggggtatcctgcacttggaagaagaagtagaaaaaggaagaaatatagtgataatttgattcttcgtcgccgtactaaatagt

SEQ ID NO: 9143 - protein, 142 aa, Gossypium raimondii
MPLGTAMHNIETTLGRGGQLARAAGAVAKLIAKEGKSATLKLPSGEVRLISKNCSATVGQVGNVGVNQKSSGRAGSKCWLGKRPVVRGVVMNPVDHPHGGGEGRAPIGRKKPATPWGYPALGRRSRKRNKYSDNLILRRRSK

SEQ ID NO: 9144 - protein, 204 aa, Amaranthus tuberculatus
GGGHKRLYRKIDFRRNEKDIYGRIVTIEYDPNRNAYICLIHYGDGEKRYILHPRGAIIGDTIVSGTEVPIKMGNALPLTDMPLGTAIHNIEITLGKGGQLARAAGAVAKLIAKEGKSATLKLPSGEVRLISKNCSATVGQVGNVGVNQKRLGRAGSKRWLGKRPVVRGVVMNPVDHPHGGGEGRAPIGRKTHNPLGLSCTWKKK

SEQ ID NO: 9145 - protein, 83 aa, Lippia dulcis
MFFKIRLTTRSIITFCMSSEIESRYKFSQFVTYHTICYINRQMFLTIMNSNRMADHCRYNGRCAGPSYYYFFFCFFINLINFS

SEQ ID NO: 9146 - protein, 125 aa, Panax ginseng
MPLGTAIHNIEITRGKGGQLARAAGAVAKLTAKEGKSATLKLPSGEVRLISKNCSATVGQVGNVGVNQKSLGRAGSKRWLGKRPVVRGVVMNPVDHPHGGGEGRAPIGRKKTHNPLGLSCTWEKK

SEQ ID NO: 9147 - protein, 108 aa, Medicago truncatula
RNRLIYGQHHCGKGRNARGIITAGHRGGGHKRLYRKIDFRRNEKDIYGRIVTIEYDPNRNAHICLIHYGDGEKRYILHPRGAIIGDTIVYGTEVPIKMGNALLQPICP

SEQ ID NO: 9148 - protein, 144 aa, Trifolium pratense
TDMPLGTAIHNIEITLGRGGQLARAAGAVAKLIAKEGKSATLKLPSGEVRLISKNCSATVGQVGNVGANQKSLGRAGAKRWLGKRPVVRGVAMNPVDHPHGGGEGKAPIGRKKPSTPWGYPALGRRTRKRNKYSDNLILRRRSK

SEQ ID NO: 9149 - protein, 134 aa, Centaurea maculosa
MPLGTAIHNIEITLGKGGQLARAAGAVAKLIAKEGKSATLKLPSGEVRLISKNCSATVGQVGNVGVNQKSLGRAGSKRWLGKRPVVRGVVMNPVDHPHGGGEGRAPIGRKRPTTPWGYPALGKRSRKRNNIVII

SEQ ID NO: 9150 - protein, 196 aa, Lotus japonicus
GKIVTLEYVPNRNAYICLIHYGDGEKRYILPPRGAIIGDTIVSGTEVPIKMGNALPLSTAIHNIEITFGKGGKLARAAGAVAKLIAKEGKSATLKLPSGEVRLISKNCSATVGQVGNVGVNQKSLGRAGSKCWLGKRPVVRGVVMNPVDHPHGGGEGRAPIGRKKPVTPWGYPALGRRSRKRKKYSDNLILRRRTK

SEQ ID NO: 9151 - protein, 142 aa, Lippia dulcis
MPLGTAIHNIEITLGKGGQLVRAAGAVAKLIAKEGKSATLKLPSGEVRLISKNCSATVGQVGNVGANQKSLGRAGSKRWLGKRPVVRGVVMNPVDHPHGGGEGRAPIGRKKPTTPWGYPALGRRSRKRNKYSDNLIVRRRSK

SEQ ID NO: 9152 - protein, 97 aa, Arnica chamissonis
MLCMAVPKGISVEVDSSFLSIKTPSQTVQASSKAYGFLDVDGDIYTDGSYIYGIMKYHMGGYIGIKICRITHVMIFYILGLPVPSSGLCSSCSIQTE

SEQ ID NO: 9153 - protein, 2286 aa, Ricinus communis
MKGHQFKSWIFELREILREIKNSHYFLDSWTQFNSVGSFIHIFFHQERFIKLLDSRIWSILLSRNSQGSTSNRYFTIKGVVLFVVVVLIYRINNRKMVERKNLYLTGLLPIPMNSIGPRNDTLEESFWSSNINRLIVSLLYLPKGKKISESSFLDPKESTWVLPITKKCIMSESNWGSRWWRNWIGKKRDSSCKISNETVAGIEISFKEKDIKYLEFLFVYYMDDPIRKDHDWELFDRLSPRKGRNIINLNSGQLFEILVKDWICYLMFAFREKISIEVEGFFKQQGARSTIQSNDIEHVSHLFSRKKWAISLQNCAQFHMWQFRQDLFVSWGNNSHESDFFRNISRENWIWLDNVWLVNKDRFFSKARNMSSNIQYDSTRSSFVQGRNSSQLKGSSDQSRDHFDSISNEDSEYHTLINQRKIQQLKERSILWDPSFLQTERTEIESDRFPKCLSGYSSMSRLFTEGEKEMNNHLLPEEIEEFLGNPTRSIRSFFSDRSSELHLGSNPTERFTRDQKLLKKEQDVSFVPSRRSENKEIVNIFKIITYLQNTVSIHPISPDPGCDMVLKDELDMDSSNKISFLNKNPFFDLFHLFHDRNGGGYTLHRDFESEERFQEMADLFTLSITEPDLVYHKGFTFFIDSYGLDQKQFLNEVFNSRDESKKKSLLVLPPIFYEENESFYRRIRKKWVRISCGNDFEDPKQKIVVFASNNIMEAVNQYGLILNLIQIQYSTYGYIRNVLTQFFLMNRSDRNFEYGIQRDPIGNDTLNHRTIMKYTINQHLSNLKQSQKKWFDPLIFLSRTERSMNWDPNAYRYKWSNGSKNFQEHLEHFISEQKNRFLFQVVFDRLRINQYSIDWSEVIDKKDLSKSLRFFLPKLLLFLSKFLLFLSNSLPFFFVSFGNIPIHRSEIHIYELKGPNDPLCNQLLESIGLQIVHLKKWKPFLLDDHDTSQKSKFLINGGTISPFLFNKIPKWMIDSFHTRNNRRKSFDNTDSFFSMISQDQDNWLNPVKPFYRSSLISSFYKANRLRFLNNLHHFWFYCNKRFPFYVEKARIKNYDFTYGQFLNILFIRNKIFSLCGGKKKHAFLERDTISPIESQVSNIFIPNDFPQSGNERYNLYKSFHFPIRSDPFVHRAIYSIADISGTPLTEGQIVNFERTYCQPLSDMNLSDSEGKNLHQYLNFNSNMGLIHTPCSEKYLPSEKRKKRSLCLKKCVEKGQMYRTFQRDSAFSTLSKWNLFQTYMPWFLTSTGYKFLNLLFLDTFSDLLPILSSSQKFVSIFHDIMHGSDISWRILQKKLCLPQWNLISEISSKCLHNLLLSEEMIHRNNEPPLISTHLRSPNVREFLYSILFLLLVAGYLVRTHLLFVSRAYSELQTEFEKVKSLMIPSYMIELRKLLDRYPTSELNSFWLKNLFLVSLEQLGDFLEEMRGSASGGNMLWGGGPAYGVKSIRSKKKFLNINLIDLISIIPNPINRITFSRNTRHLSHTSKEIYSLIRKRKNVNGDWIDDKIESLVANSDSIDDKEREFLVQFSTLTTEKRIDQILLSLTHSDHLSKNDSGYQVIEEPGAIYLRYLVDIHKKYLMNYEFNTPCLAERRIFLAYYQTTTYSQTSCGVNSFHFPSHGKPFSLRLALSPSRGILVIGSIGTGRSYLVKYLATNSYLPFITVFLNKFLDNKPKGFLIDDSDDIDDSDDIDVSDDIDRDFDTELEFLTRMNALTMDMMPEIDRFYITLQFELAKAMSPCIIWIPNIHDLDVNESNYLSLGLLVNYLSRDCERCSTRNILVIASTHIPKKVDPALIAPNKLNTCIKIRRLLIPQQRKHFFTLSYTRGFHLKKKMFHTNGFGSITMGSNVRDLVALTNEALSISITQKKSIIDTNIIRSALHRQTWDLRSQVRSVQDHGILFYQIGRAVAQNVFLSNCPIDPISIYMKKKSCNEGDSYLYKWYFELGTSMKKLTILLYLLSCSAGSVAQDLWSLPGPDEKNGITYYGLVENDSDLVHGLLEVESALVGSSRTEKDCSQFDNDRVTLLLRPEPRSPLDMMQNGSCSILDQRFLYEKYESEFEEGEGEEVLDPQQIEEDLFNHIVWAPRIWRPWGFLFDCIERPNELGFPYWARSFRGKRIIYNEEDELQENDSEFLQSGAMQYQIRDRSSKEQGFFRISQFIWDPADPLFFLFKDQPLVSVFSHREFFADEEMSKGLLTSQTDPPTSIYKCWFIKNTQEKHFELLIHRQRWLRTNSSLSNGFFRSNTLSESYQYLSNLFLSNGTLLDQMTKALLRKRWLFPDEMKIGFM

SEQ ID NO: 9154 - protein, 142 aa, Cajanus cajan
MPLGTAIHNIEITLGKGGQLARAAGAVAKLIAKEGKSATLKLPSGEVRLISKNCSATVGQVGNVGVNQKNLGRAGSKCWLGKRPVVRGVVMNPVDHPHGGGEGRAPIGRKKPATPWGFPALGKRSRKRNKYSDNLILRRRSK

SEQ ID NO: 9155 - protein, 129 aa, Zea mays
SRGRGGQLARAAGAVAKLIAKEGKLATLRLPSGEVRLVSQNCLATVGQVGNVGVNQKSLGRAGSKCWLGKRPVVRGVVMNPVDHPHGGGEGKAPIGRKKPTTPWGYPALGRRTRKRKKYSDSFILRRRK

SEQ ID NO: 9156 - protein, 87 aa, Ricinus communis
MAIHLYKTSTPSTRNGAIDSQVKSNTRNTRNNLIYGQHHCGKGRNARGIITARHRGGGHKRLYRKIDFRRNKKDIYGRIVTIEYDPN

SEQ ID NO: 9157 - protein, 134 aa, Ceratodon purpureus
MPLGTAIHNIEITPGKGAQLVRTAGAVAKLIAKEGYLATLRLPSGEVRLVSQNSLATIGQIGNVDANNKSIGKAGSKRWLGKRPKVRGVVMNPIDHPHGGGEGRAPIGRKKPLTPWGRTALGKRTRKIKNIVIL

SEQ ID NO: 9158 - protein, 137 aa, Tripterygium wilfordii
LIDQKEESTSTDMPLGTAIHNIEITLGKGGQLARAAGAVAKLIAKEGKSATLKLPSGEVRLISKNCSATVGQVGNVGVNQKSLGKAGSKCWLGKRPIVRGVVMNPVDHPHGGGEGRAQIGRKKPVNPLGLSCTWKKK

SEQ ID NO: 9159 - protein, 64 aa, Ricinus communis
MFVMLNIFSLICICLNSVLYSSNFFFTKLPEAYAFLNPIVDVMPVIPVLFFLLAFVWQAAVSFR

SEQ ID NO: 9160 - protein, 161 aa, Medicago truncatula
GHKRLYRKIDFRRNEKDIYGRIVTIEYDPNRNAHICLIHYGDGEKRYILHPRGAIIGDTIVYGTEVPIKMGNALPLKSTSTDMPLGTAIHNIEITLGKGGQLARAAGAVAKLIAKEGKSATLKLPSGEVRLISKNCSATVGQVGNVGVNQKVWAEPELNVG

SEQ ID NO: 9161 - protein, 142 aa, Cajanus cajan; identical to SEQ ID NO: 9154

SEQ ID NO: 9162 - protein, 271 aa, Orobanche aegyptiaca
MYDHYIEFNRVILFHPLIKIFNNMIHLYKTSTLSTHTRNNLIYGQHYCGKGRNARGIITINHRGGGHKRLYRKIDFKRNKKDIYGKIVTIEYDPNRNAHICLIHYGDGEKRYILHPKGAKIGDIVVVSSTRVLIKMGNALPLTNMPLGAAIHNIEITPGRGGQLVRAAGAVAKLIAKEGKSVTLKLPSGEIRLISQNCLATVGQVGNVGTIHKSLGKAGSKRWLGKRPVVRGIVMNPVDHPHGGGEGKAPIGKKRPTTPWGYPALAKEVEK

SEQ ID NO: 9163 - protein, 130 aa, Artemisia annua
MAINLYKTSTPSTRNGTVDSQVKRNNLIYGQHHCGKGRNARGIITAGHRGGGHKRLYRKIDFRRNEKDIYGRIVTIEYDPNRNAYICLIHYRDGEKRYILHPRGAIIGDTIVSGTEVPIKMGNALPLSAV

SEQ ID NO: 9164 - protein, 155 aa, Lotus japonicus
MGNALPLKSTSTDMPLGTAIHNIEITFGKGGKLARAAGAVAKLIAKEGKSATLKLPSGEVRLISKNCSATVGQVGNVGVNQKSLGRAGSKCWLGKRPVVRGVVMNPVDHPHGGGEGRAPIGRKKPVTPWGYPALGRRSRKRKKYSDNLILRRRTK

SEQ ID NO: 9165 - protein, 142 aa, Lotus japonicus
MPLGTAIHNIEITFGKGGKLARAAGAVAKLIAKEGKSATLKLPSGEVRLISKNCSATVGQVGNVGVNQKSLGRAGSKCWLGKRPVVRGVVMNPVDHPHGGGEGRAPICRKKPRTPWGYPALGKRSRKRKKYSDNLISRRRTK

SEQ ID NO: 9166 - protein, 142 aa, Juglans hindsii x Juglans regia
MPLGTAIHNIEITLGKGGQLARAAGAVAKLIAKEGKSATLKLPSGEVRLLSKNCSATVGQVGNVGVNQKSLGRAGSKCWLGKRPVVRGVVMNPVDHPHGGGEGRAPIGRKKPATPWGYPALGRRSRKRNKYSDNLILRRRSK

SEQ ID NO: 9167 - protein, 225 aa, Conyza canadensis
GHRGGGHKRLYRKIDFRRNEKDIYGRIVTIEYDPNRNAYICLIHYRDGEKRYILHPRGAIIGDTIVSGTEVPIKMGNALPLTDMPLGTAIHNIEITLGKGGQLARAAGAVAKLIAKEGKSATLKLPSGEVRLISKNCSATVGQVGNVGVNQKSLGRAGSKRWLGKRPVVRGVVMNPVDHPHGGGEGRAPIGRKKPTTPWGYPALGKRSRKRNKYSDNLILRRRSK

SEQ ID NO: 9168 - protein, 142 aa, Eucalyptus grandis
MPLGTAIHNIEITLGKGGQLARAAGAVAKLIAKEGKSATLKLPSGEVRLISKNCSATVGQVGNVEVNQKKLGRAGSKCWLGKRPVVRGVVMNPVDHPHGGGEGRAPIGRKKPATPWGYPALGRRSRKRKKYSDNLILRRRSK

SEQ ID NO: 9169 - protein, 218 aa, Coffea canephora
MGQKINPLGFRLGTTQGHHSLWFAQPKNYSEGLQEDQKIRNCIKNYVQKNTKISSGVEGIARIEIQKRIDLIQVIIFMGFPKPLLENQPRGIEELQTNLQKKFNSVNRKFNIAITKIAKPYGNPNILAEYIAGQLKNRVSFRKAMKKAIELTEQANTKGIQVQIAGRIDGKEIARVEWIRRGRVPLQTIRAKIDYCSYTVRTIYGVLGIKIWIFIDEE

SEQ ID NO: 9170 - protein, 218 aa, Arachis hypogaea
MGQKINPLGFRLGTTQSHDSLWFAQPINYSENLQEDKKIRDYIKNYIKINIRISSGVEGIAGIKIKKRIDLIQVIISMGFPKLLIEGKPGRIEELQMNLQKKLNCVNRKLNIAITRIANPYGHPNILAEFIAGQLRNRVSFRKAMKKAIELTQQAGTKGIQVQIAGRIDGKEIARVEWIREGRVPLQTIRAKIDYCSYTVRTIYGVLGIKVWIFVNKE

SEQ ID NO: 9171 - protein, 220 aa, Persea americana
MGQKINPLGFRLGENQSHRSLWFAQPKSYYIGLQEDEKIRDCIKIYVQKNIRVSSSFEGIGIAHIEIQKKMDLIQVIIYIGFPNLLIEGQTRGIEELQINVQKGLHSVNRRLNIAITRVAKPYGQPNILAEYIALQLKNRVSFRKAMKKAIELTEQADTKGIQVEIAGRIDGKEIARVEWIREGRVPLQTIRAKIDYCSYTVRTAYGALGIKIWIFVDEQ

SEQ ID NO: 9172 - protein, 2094 aa, Phaseolus coccineus
MKGHQFKSWIFELREILKEIKNSRYFLDSWTQFNSAGFLIHIFFHQESFIKLLDSRIWSILLSRNSQGSTSNRYFTIKYVVLFVVAVLIYRINNRKMVERKNPYLTRLLPIPMNSIGPKNDTLEESSESSNINRLIVPLLYLPKGKKISESSFLDPKESTRVLPITKKYIMPEFNWGSRWWRNWIGKKSYSSLTDSSQLKGSSDQSKDSFDSIRNEDSKYHTLINQREIQQLKERSILCWDPSFLQTERTEIESERFLKNLSGYSSMCRLFMEREKQMNNHLLPEEIEEFLGNPARATRSFFSDRWSELHLGSNPTDRSTRDQKLLKKEQKKHLALSRRSEKKEIVNLFKIIMYLQNTVSIHPISSYRGCDMVPKDELDSSNKISFLNKNPFWGFFHLFHDRNRGRYTLHHDFESEDLFQEMADLFTLSITEPDLVYHKEFDFSIDSSGLDQKHFLNELLNSRDESKKHSLLVLPPLFYEQNESFYRRIIKKWVQTSCGNNLEDPKPKIVVFASNNIMEAVNQYRLIRNLIQIQYSTHVYIRNVLNRFNCNFEYGIQRYQIGNDTLNHRTRMKYTINQHFSNLKKSQKKWFDPLILISRTERSMNWDPNAYRYKWSNGSKNFQEHLDYFISEQNSLQVVFDRLHINQYSIDWSEVIDKKDLSKSLCLFLSKLLLFLPKFLLFLSNSLPSFFFVSFGGISIHRSEIHIYELKGPNDPLCNQLLESIGLQIFHLKKRKPLLLDDQDTSQKSKFLINGGTISPFLFNKIPKWMIDSFHTRKNRRKSFDNTDSYFSMISHDPDNWLNPVKPFHRSSLIYYFYKANQLRFLNNQYHFCFYCNKRFPFYVEKARINNYDFTYGQFLKILFIRNKIFSFCDGQKKHAFLKRDTISPIELQVSNILIPNDFPQSGDEGYNFYKSFHFPIRYDPFVRGAIYSIADISGTPLTEGQIVHFEKTYCQPLSDMNIPDSEGKNLYQYLNFNSNMGWIHTPCSEKYLPSEKRKKRSSCLQKCLEKGQMYRTFQQDSVFSTLSKWNLFQTYIPWFLTSTGYKYLNFIFLDTFSDLLPILSSSQKFVSIFHDIMHGSDILWRIRQIPLCLPQWNLISEIPGNCFHNLLLSEEMTHRNNELLLISTHLRSLNVQEFFYSILFLLLVAGYLVRTHLLFVSRVYSELQTEFEKVKSLMIPSYMIELRKLLDRYPTSELNSFWLKNLFLVALEQLGDSLEEIRSFAFGGNMLWGGGPAYGVKSIRSKNKSWNLIDLISIIPNPINRIAFSRNTRHLSHPSKAIYSLIRKIKNVNGDWIDDQIESWVSNTDSIDDKEKEFLVQFSTLTTEKRIDQILLSLTHSDLLSKNNSGYQISEQPGAIYLRYLVDIHKKYLMIYEFNTSCLVERHIFLANYQTITYSQTLWGANSFHFPSHGKPFSLRLALPPPSRGILVIGSIGTGRSYLVKYLAKNSYVPFITVFLNKFLDNKPKGFLIDDSDDIDDSDDSDDIDRDLDIELELLTMMNTLTMDMMPEIDRFYITFHFELAKAMSPCIIWIPNIHDLDVNESNYLSLGLLVNYLSRDCERCSTRNILVIASTHIPQKVDPALIAPNQFNTCIKIRRLLIPQQRKHFFTLSYTRGFHLEKKMSHTNGFGSTTMGSNVRDLVALNNEALSISIIQKKSIIDTNIISSVLHRQTWDFRSQVRSVQDHGILFYQIGRAVSQNVLLSNCSIDPISIYMKKKSCDGGDSYLYKWYFELGTSMKKLTILLYLLSCSAGSVAQDLWSLPGPDEKNGITSYGLVENNSDLVHGLLEVEGALVGSSRTEKDCSQFDKDRVTLLLRSEPRNPLNRIQNGSYSIVDQRFLYEKYESEFEERGGVLDPQQIEEDFFNHIVWAPRIWRPWGFLFDCIERPNSLGFPYWARSFRDKRIIYDEEDELQENDSEFLQGGTMQYQTRDRSSKEQGFFRISQFIWDPADPLFFLFKDQPFVSVFSHRQFFTDEEMSRELLTSQTDLPTSIYKHWFIKNTQEKHFELLIHCQRWLRINSSSSKGFFPSNTLSESYQYLSNLFLSNEALLDQMTKTLLRKRWLFPDEIVVAICSNNESLVSLNHSKKKNR

SEQ ID NO: 9173 - protein, 251 aa, Ipomoea batatas
PPRGKNLIYGQHRCGKGRNARGIITARHRGGGHKRLYRKIDFRRNEKDIYGRIVTIEYDPNRNAYICLIHYGNGEKRYILHPRGAIIGDSIVSGTEVSIKIGNALPLTEMPLGTAIHNIEITLGKGGQLARAAGAVAKLIAKEGKSATIKLPSGEVRLISKNCSATVGQVGNVGVNQKSLGRAGAKRWLGKRPVVRGVVMNPVDHPHGGGEGRAPIGRKKPTTPWGYPALGRRSRKRNKYSEKFILRRRSK

SEQ ID NO: 9174 - protein, 142 aa, Lotus japonicus
MPLGTAIHNIEITFGKGGKLARAAGAVAKLIAKEGKSATLKLPSGEVRLISKNCSATVGQVGNVGVNQKSLGRAGSKCWLGKRPVVRGVVMNPVDHPHGGGEGRAPIGRKKPVTPWGYPALGRRSRKRKKYSDNLILRRRTK

SEQ ID NO: 9175 - protein, 244 aa, Medicago truncatula
RNRLIYGQHHCGKGRNARGIITAGHRGGGHKRLYRKIDFRRNEKDIYGRIVTIEYDPNRNAHICLIHYGDGEKRYILHPRGAIIGDTIVYGTEVPIKMGNALPLKSTSTDMPLGTAIHNIEITLGKGGQLARAPGAVAKLIAKEGKSATLKLPSGEVRLISKNCSATVGQVGNVGVNQKSLGRAGAKRWLGKRPVVRGVVMNPVDHPHGGGEGRAPIGRKKPSTPWGYPALGRRSRKKKNIVII

SEQ ID NO: 9176 - protein, 149 aa, Nicotiana tabacum
EESTSTDMPLGTAIHNIEITLGKGGQLARAAGAVAKLIAKEGKSATLKLPSGEVCLISKNCSATVGQVGNVGVNQKSLGRAGSKRWLGKRPVVRGVVMNPVDHPHGGGEGRTPIGRKKPTTPWGYPALGRRSRKRNKYSDNLILRRRSK

SEQ ID NO: 9177 - protein, 142 aa, Lotus japonicus; identical to SEQ ID NO: 9174

SEQ ID NO: 9178 - DNA, 165 bp, Arabidopsis thaliana
atggcttcctctatgctctcttccgctactatggttgcctctccggctcaggccactatggtcgctcctttcaacggacttaagtcctccgctgccttcccagccacccgcaaggctaacaacgacattacttccatcacaagcaacggcggaagagttaactgc

SEQ ID NO: 9179 - protein, 55 aa, Arabidopsis thaliana
MASSMLSSATMVASPAQATMVAPFNGLKSSAAFPATRKANNDITSITSNGGRVNC
